United States Patent
De Giorgi et al.

(10) Patent No.: US 12,385,104 B2
(45) Date of Patent: Aug. 12, 2025

(54) METHODS AND COMPOSITIONS FOR DETECTING TRANSFUSION-TRANSMITTED PATHOGENS

(71) Applicant: The United States of America, as represented by the Secretary, Dept. of Health and Human Services, Bethesda, MD (US)

(72) Inventors: Valeria De Giorgi, Bethesda, MD (US); Robert D. Allison, Bethesda, MD (US); Harvey J. Alter, Bethesda, MD (US)

(73) Assignee: The United States of America, as represented by the Secretary, Department of Health Human Services, Bethesda, MD (US)

( * ) Notice: Subject to any disclaimer, the term of this patent is extended or adjusted under 35 U.S.C. 154(b) by 1056 days.

(21) Appl. No.: 17/425,228

(22) PCT Filed: Jan. 31, 2020

(86) PCT No.: PCT/US2020/016262
§ 371 (c)(1),
(2) Date: Jul. 22, 2021

(87) PCT Pub. No.: WO2020/160502
PCT Pub. Date: Aug. 6, 2020

(65) Prior Publication Data
US 2022/0119898 A1 Apr. 21, 2022

Related U.S. Application Data

(60) Provisional application No. 62/799,482, filed on Jan. 31, 2019.

(51) Int. Cl.
*C12Q 1/70* (2006.01)
*C12Q 1/6876* (2018.01)
*C12Q 1/6888* (2018.01)

(52) U.S. Cl.
CPC .......... *C12Q 1/701* (2013.01); *C12Q 1/6876* (2013.01); *C12Q 1/6888* (2013.01); *C12Q 1/702* (2013.01); *C12Q 1/703* (2013.01); *C12Q 1/705* (2013.01); *C12Q 1/706* (2013.01); *C12Q 1/707* (2013.01); *C12Q 2600/16* (2013.01)

(58) Field of Classification Search
None
See application file for complete search history.

(56) References Cited

U.S. PATENT DOCUMENTS

| | | | | |
|---|---|---|---|---|
| 6,582,908 B2 * | 6/2003 | Fodor | ................... | C07H 21/00 506/30 |
| 10,100,374 B2 * | 10/2018 | Leying | ................ | C12Q 1/6823 |
| 2004/0166494 A1 * | 8/2004 | Green | .................... | B82Y 30/00 435/6.19 |
| 2006/0110744 A1 * | 5/2006 | Sampas | ................ | C12Q 1/6883 435/6.14 |
| 2011/0033854 A1 * | 2/2011 | Drmanac | ............. | B01J 19/0046 435/6.12 |
| 2012/0088904 A1 | 4/2012 | Bartels et al. | | |
| 2013/0157258 A1 | 6/2013 | Bartels et al. | | |
| 2013/0267429 A1 * | 10/2013 | Gardner | ............... | C12Q 1/6876 506/8 |
| 2018/0340215 A1 * | 11/2018 | Metsky | ................ | C12Q 1/6816 |

FOREIGN PATENT DOCUMENTS

| | | | |
|---|---|---|---|
| CN | 106011309 | * 10/2016 | |
| WO | WO-2007130519 A2 * | 11/2007 | ............... C12Q 1/70 |
| WO | WO 2009/087685 | 7/2009 | |
| WO | WO 2012/002594 | 1/2012 | |

OTHER PUBLICATIONS

Chen et al., "Using a Pan-Viral Microarray Assay (Virochip) to Screen Clinical Samples for Viral Pathogens," *Journal of Visualized Experiments*, 50:e2536, 2011 (4 pages).

De Giorgi et al., "A microarray-based pathogen chip for simultaneous molecular detection of transfusion-transmitted infectious agents," *Journal of Translational Medicine*, 17:156, 2019 (9 pages).

Grigorenko et al., "Highly Multiplex Real-Time PCR-Based Screening for Blood-Borne Pathogens on an OpenArray Platform," *The Journal of Molecular Diagnostics*, vol. 19, No. 4, pp. 549-560, 2017.

Kourout et al., "Multiplex detection and identification of viral, bacterial, and protozoan pathogens in human blood and plasma using a high-density resequencing pathogen microarray platform," *Transfusion*, vol. 56, pp. 1537-1547, 2016.

Kurn et al., "Novel Isothermal, Linear Nucleic Acid Amplification Systems for Highly Multiplexed Applications," *Clinical Chemistry*, vol. 51, No. 10, pp. 1973-1981, 2005.

Urisman et al., "E-Predict: a computational strategy for species identification based on observed DNA microarray hybridization patterns," *Genome Biology*, 6:R78, 2005 (14 pages).

Wapner et al., Chromosomal Microarray versus Karyotyping for Prenatal Diagnosis, *The New England Journal of Medicine*, vol. 367, No. 23, pp. 2175-2184, 2012.

* cited by examiner

*Primary Examiner* — Carla J Myers
(74) *Attorney, Agent, or Firm* — Klarquist Sparkman, LLP

(57) ABSTRACT

Probe sets capable of detecting pathogen nucleic acids in a sample are described. The probe set can be provided on a solid support, such as a microarray. Methods of detecting pathogen nucleic acids in a sample using the probe set are also provided. In some examples, the probes and methods are capable of detecting one or more RNA viruses, one or more DNA viruses, one or more bacterial nucleic acids, and/or one or more protozoan nucleic acids in a sample.

24 Claims, 3 Drawing Sheets
Specification includes a Sequence Listing.

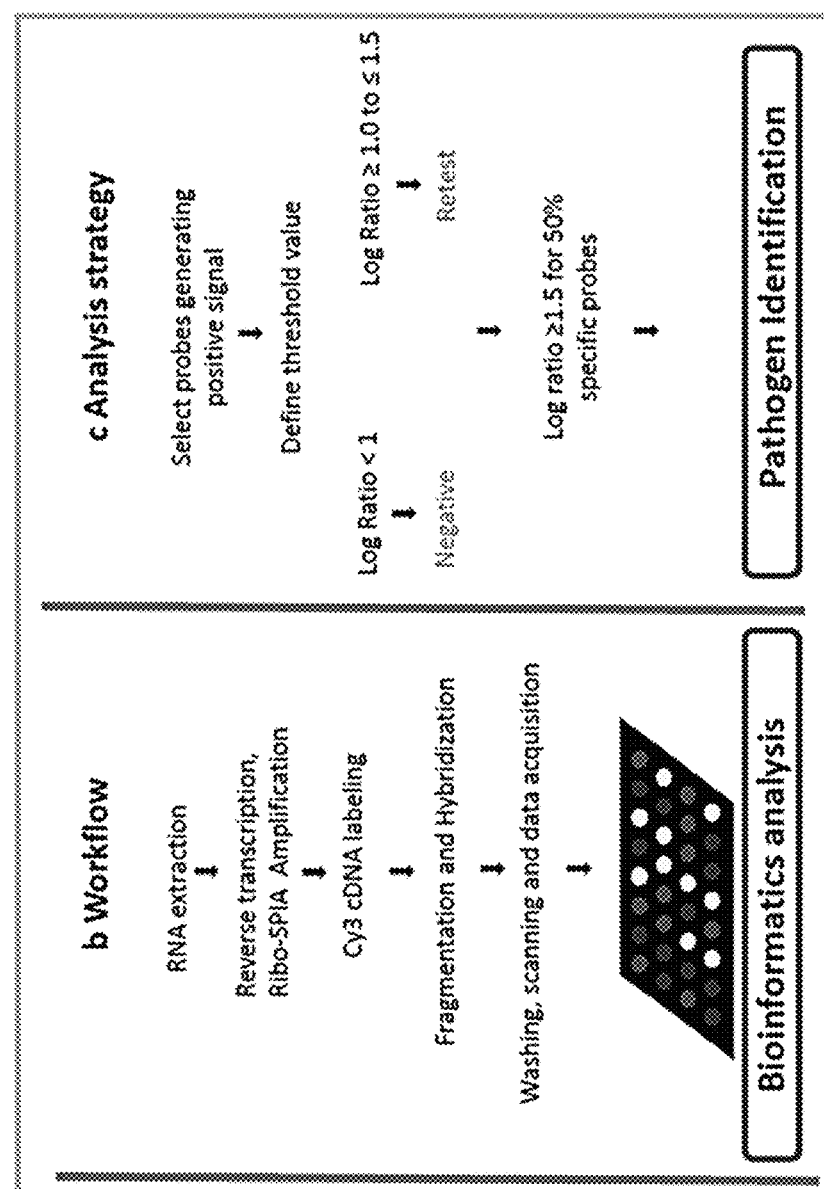

ID NOs: 1-1300, 1391-1570, and 1691-
METHODS AND COMPOSITIONS FOR DETECTING TRANSFUSION-TRANSMITTED PATHOGENS

CROSS REFERENCE TO RELATED APPLICATIONS

This application is the U.S. National Stage of International Application No. PCT/US2020/016262, filed Jan. 31, 2020, which was published in English under PCT Article 21 (2), which in turn claims the benefit of U.S. Provisional Application No. 62/799,482, filed Jan. 31, 2019, which is incorporated herein by reference in its entirety.

ACKNOWLEDGMENT OF GOVERNMENT SUPPORT

This invention was made with Government support under project number Z01 CL002068-28 by the National Institutes of Health, Clinical Center. The Government has certain rights in the invention.

FIELD

This disclosure relates to compositions and methods for detecting pathogens in a sample, particularly probes and microarrays and methods of their use.

BACKGROUND

Each year millions of blood donations are collected globally and millions of blood components are transfused to patients. Though screening of these blood units using serologic and nucleic acid testing (NAT) has greatly reduced the risk of some transfusion-transmitted infections (TTIs), the vast majority of bloodborne agents are not screened (Alter et al., *Semin. Hematol.* 44:32-41, 2007; Glynn et al., *Transfusion* 53:438-454, 2013; Leveton et al., *Transfusion* 36:919-927, 1996). The U.S. Food and Drug Administration-licensed methods for infectious disease screening of donor blood include: 1) nucleic acid testing (NAT) for Hepatitis B virus (HBV), Hepatitis C virus (HCV), HIV-1 and -2, *Babesia*, West Nile virus (WNV) and Zika virus (ZIKV); and 2) immunoassays for HBV, HCV, HIV-1 and -2, cytomegalovirus (CMV), human T-cell lymphotropic virus I and II (HTLV), *Treponema pallidum* (syphilis), and *Trypanosoma cruzi* (Chagas). HTLV, syphilis, and Chagas antibody testing fail to detect these pathogens during a window period and Chagas is screened only once on samples from first-time blood donors (Duncan et al., *Exp. Rev. Mol. Diagn.* 16:83-95, 2016).

The American Association of Blood Banks Transfusion-Transmitted Diseases Committee produced a list of over 30 pathogens of concern for transmission via blood that included bacteria, parasites, prions and viruses (Stramer et al., *Transfusion* 49:1S-29S, 2009). Only prions cannot be detected by currently available technology. Nearly all the other agents currently require individual qPCR or serologic testing and it is logistically impractical and cost prohibitive to test all known and potential agents individually (Stramer *ISBT Science Series* 9:30-37, 2014; Atrey et al., *Transfusion* 51:1855-1871, 2011).

Multiplex PCR-based devices for testing blood-borne pathogens are limited. FDA-approved blood donor screening assays that use transcription-mediated amplification for multiplex detection of HBV, HCV, and HIV 1 and 2 include the cobas TaqScreen MPX Test (Roche Molecular Systems, Inc.) and the Procleix Ultrio Plus (Gen-Probe, Inc.) (Duncan et al., *Exp. Rev. Mol. Diagn.* 16:83-95, 2016).

SUMMARY

A multiplex assay capable of detecting many, most, or all known pathogens of concern in a single small blood sample with high sensitivity and specificity could significantly increase the safety of the blood supply. Further, to counter emerging pathogens, the platform should be adaptable for rapid addition and validation of probes to detect new agents. Microarray-based technology offers the advantage of multiplex detection in a miniaturized format with high adaptability.

Disclosed herein are probe sets that include probes with at least 90% identity (such as at least 90%, at least 95%, at least 98%, or at least 99% identity) with the nucleic acid sequences of SEQ ID NOs: 1-1300, 1391-1570, and 1691-1769, or subsets thereof. In some examples, the probe set includes probes with the nucleic acid sequences of SEQ ID NOs: 1-1300, 1391-1570, and 1691-1769, or a subset thereof. In some embodiments, the probe set includes one or more probes (such as 30 or more probes) for one or more RNA viruses, such as one or more of Chikungunya virus, Dengue virus type 1, Dengue virus type 2, Dengue virus type 3, Dengue virus type 4, Hepatitis A virus, Hepatitis C virus type 1, Hepatitis C virus type 2, Hepatitis C virus type 3, Hepatitis E virus, Human immunodeficiency virus type 1, Human immunodeficiency virus type 2, Human T-lymphotropic virus type I, Human T-lymphotropic virus type II, West Nile virus, and Zika virus.

In other embodiments, the probe set includes one or more probes for one or more DNA viruses, such as one or more of cytomegalovirus (CMV, also known as HHV-5), Epstein Barr virus (EBV, also known as HHV-4, for example subtype B95-8 and/or AG876)), human herpes virus 8 (HHV-8), Hepatitis B virus (such as one or more of Hepatitis B virus subtype adw, subtype ayw, subtype adr, and subtype ayr), human parvovirus B19, and human papillomavirus (HPV, such as one or more of type 6, 11, 16, and 18). In some embodiments, the probe set includes probes with at least 90% identity (such as at least 90%, at least 95%, at least 98%, or at least 99% identity) with the nucleic acid sequences of SEQ ID NOs: 1770-2647, or a subset thereof. In some examples, the probe set includes probes with the nucleic acid sequences of SEQ ID NOs: 1770-2647, or a subset thereof.

Further disclosed are probe sets that include one or more probes for one or more bacterial or protozoan pathogens, such as one or more of *Treponema pallidum*, *Ehrlichia chaffeensis*, *Ehrlichia ewingii*, *Ehrlichia muris*, *Borrelia burgdorferi*, *Coxiella burnetii*, *Trypanosoma brucei*, *Trypanosoma cruzi Leishmania major*, *Babesia microti*, *Plasmodium falciparum*, and *Plasmodium vivax*. In some embodiments, the probe set includes probes with at least 90% identity (such as at least 90%, at least 95%, at least 98%, or at least 99% identity) with the nucleic acid sequences of SEQ ID NOs: 2648-3207, or a subset thereof. In some examples, the probe set includes probes with the nucleic acid sequences of SEQ ID NOs: 2648-3207, or a subset thereof.

In some embodiments, the disclosed probe sets include at least one negative control probe and/or at least one positive control probe. In some examples the negative control probe is a probe with at least 90% identity (such as at least 90%, at least 95%, at least 98%, or at least 99% identity) with the nucleic acid sequences of any one of SEQ ID NOs: 1571-

1690. In other examples the control probe is a probe with at least 90% identity (such as at least 90%, at least 95%, at least 98%, or at least 99% identity) with the nucleic acid sequences of any one of SEQ ID NOs: 3208-3628.

In one non-limiting embodiment, the probe set is a set of probes including each of SEQ ID NOs: 1-1769. In another non-limiting embodiment, the probe set is a set of probes including each of SEQ ID NOs: 1770-2647 and 3208-3628, each of SEQ ID NOs: 2648-3628, or each of SEQ ID NOs: 1770-3628. In a further non-limiting embodiment, the microarray includes probes including each of SEQ ID NOs: 1-3628.

Also disclosed are microarrays that include a probe set described herein, for example, wherein the probes are covalently linked to a solid support. In one non-limiting example, the microarray includes probes with at least 90% identity (such as at least 90%, at least 95%, at least 98%, at least 99%, or at least 100% identity) with the nucleic acid sequences of SEQ ID NOs: 1-1300, 1391-1570, and 1691-1769, or subsets thereof. In another non-limiting example, the microarray includes probes with at least 90% identity (such as at least 90%, at least 95%, at least 98%, at least 99%, or at least 100% identity) with the nucleic acid sequences of SEQ ID NOs: 1770-2647, or subsets thereof. In a further non-limiting example, the microarray includes probes with at least 90% identity (such as at least 90%, at least 95%, at least 98%, at least 99%, or at least 100% identity) with the nucleic acid sequences of SEQ ID NOs: 2648-3207, or subsets thereof. In yet another non-limiting embodiment, the microarray includes probes with at least 90% identity (such as at least 90%, at least 95%, at least 98%, at least 99%, or at least 100% identity) with the nucleic acid sequences of SEQ ID NOs: 1770-3207, or subsets thereof. The microarray may further include negative and/or positive control probes. In one non-limiting embodiment, the microarray includes probes including each of SEQ ID NOs: 1-1769. In other non-limiting embodiments, the microarray includes probes including each of SEQ ID NOs: 1770-2647 and 3208-3628, each of SEQ ID NOs: 2648-3628, each of SEQ ID NOs: 1770-3628. In a further non-limiting embodiment, the microarray includes probes including each of SEQ ID NOs: 1-3628.

Disclosed herein are methods of detecting one or more pathogen nucleic acids in a sample. In some examples, the methods include detecting nucleic acids from one or more RNA viruses, such as one or more of Chikungunya virus, Dengue virus type 1, Dengue virus type 2, Dengue virus type 3, Dengue virus type 4, Hepatitis A virus, Hepatitis C virus type 1, Hepatitis C virus type 2, Hepatitis C virus type 3, Hepatitis E virus, Human immunodeficiency virus type 1, Human immunodeficiency virus type 2, Human T-lymphotropic virus type I, Human T-lymphotropic virus type II, West Nile virus, and Zika virus in a sample. In other examples, the methods include detecting nucleic acids from one or more DNA viruses, such as one or more of cytomegalovirus, Epstein Barr virus, human herpes virus 8, Hepatitis B virus, human parvovirus B19, and human papillomavirus.

Also disclosed are methods of detecting one or more bacterial and/or protozoan nucleic acids in a sample. In some examples, the methods include detecting nucleic acids from one or more of *Treponema pallidum*, *Ehrlichia chaffeensis*, *Ehrlichia ewingii*, *Ehrlichia muris*, *Borrelia burgdorferi*, *Coxiella burnetii*, *Trypanosoma brucei*, *Trypanosoma cruzi*, *Leishmania major*, *Babesia microti*, *Plasmodium falciparum*, and *Plasmodium vivax*.

In some examples, the methods include contacting a sample with a disclosed probe set or microarray under conditions sufficient to allow hybridization of pathogen nucleic acids present in the sample to the probes of the probe set or microarray and measuring hybridization of the sample to one or more of the probes, thereby detecting one or more nucleic acids in the sample. The sample may be a blood, serum, or plasma sample, or nucleic acids (such as RNA or cDNA) isolated from the sample. In particular examples, the sample is a blood donation sample or nucleic acids isolated from a blood donation sample. In particular examples, nucleic acids (such as RNA or cDNA) from the sample are labeled prior to contacting the probe set or microarray with the nucleic acids. In one example, the method includes preparing cDNA from the sample and labeling the cDNA. In some examples, the method does not include amplifying RNA from the sample prior to preparing the cDNA.

The foregoing and other features of the disclosure will become more apparent from the following detailed description, which proceeds with reference to the accompanying figures.

BRIEF DESCRIPTION OF THE DRAWINGS

FIGS. 1A-1C are a series of panels showing pathogen chip design (FIG. 1A), sample preparation work flow (FIG. 1B), and analysis strategy (FIG. 1C) for pathogen detection microarrays.

FIG. 2A shows SPIA amplification vs. standard (STD) method. cDNA concentration after amplification for four representative viral RNAs is shown. Starting RNA concentration was <10 ng/µl each. FIG. 2B shows Pathogen chip assay performance 1. Bars are the mean of Cy3 signal for the Chikungunya and West Nile probes hybridized to test samples positive for CHIKV and WNV and a negative plasma sample. Only probes specific to target showed a specific hybridization signal. No signal was detected for negative plasma. FIG. 2C shows Pathogen chip assay performance 2. Detection responses of four representative samples (Dengue-4) were measured over a dilution series from 10,000 to 10 genomic copies per sample. Bars are the mean of Cy3 signals for all probes to the indicated viruses hybridized to test samples.

SEQUENCE LISTING

Figure 2A:
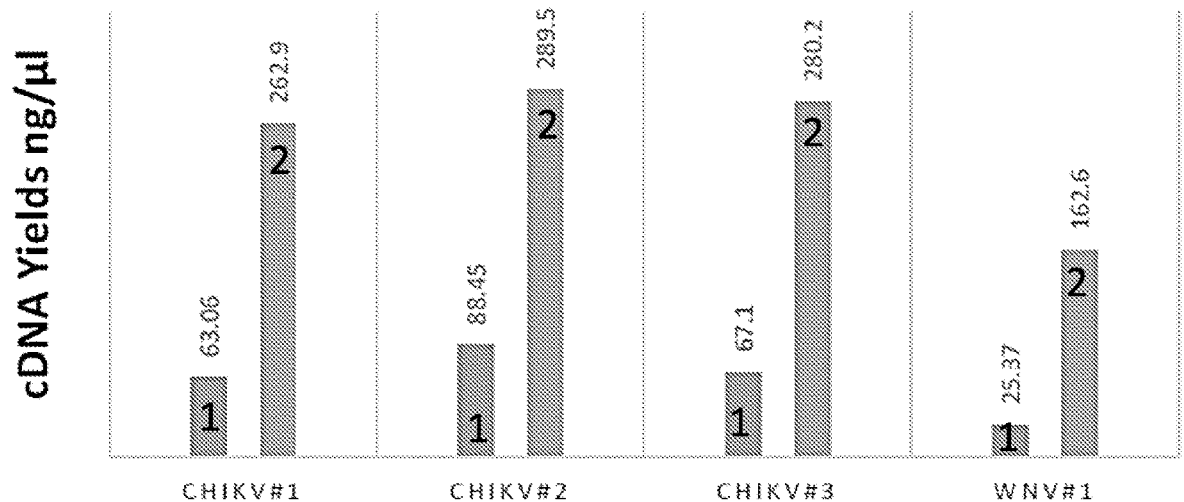
FIGS. 2A-2C are a series of graphs showing amplification method and Pathogen Chip assay performance assessed using positive control viral RNAs.

Any nucleic acid and amino acid sequences listed herein or in the accompanying sequence listing are shown using standard letter abbreviations for nucleotide bases and amino acids, as defined in 37 C.F.R. § 1.822. In at least some cases, only one strand of each nucleic acid sequence is shown, but the complementary strand is understood as included by any reference to the displayed strand.

The Sequence Listing is submitted as an ASCII text file in the form of the file named Sequence_Listing.txt, which was created on Jul. 22, 2021, and is 676,876 bytes, which is incorporated by reference herein.

In the accompanying sequence listing:
SEQ ID NOs: 1-110 are Hepatitis C virus genotype 1 probes
SEQ ID NOs: 111-210 are Hepatitis C virus genotype 2 probes
SEQ ID NOs: 211-310 are Hepatitis C virus genotype 3 probes SEQ ID NOs: 311-400 are Human Immunodeficiency virus 1 probes
SEQ ID NOs: 401-510 are Human Immunodeficiency virus 2 probes
SEQ ID NOs: 511-570 are Human T-lymphotropic virus I probes
SEQ ID NOs: 571-660 are Human T-lymphotropic virus II probes
SEQ ID NOs: 661-760 are West Nile virus NY99 probes
SEQ ID NOs: 761-870 are West Nile virus 956 probes
SEQ ID NOs: 871-900 are Chikungunya virus probes
SEQ ID NOs: 901-1000 are Dengue virus 1 probes
SEQ ID NOs: 1001-1100 are Dengue virus 2 probes
SEQ ID NOs: 1101-1199 are Dengue virus 3 probes
SEQ ID NOs: 1200-1300 are Dengue virus 4 probes
SEQ ID NOs: 1301-1390 are GB virus C/Hepatitis G virus probes
SEQ ID NOs: 1391-1500 are Hepatitis A virus probes
SEQ ID NOs: 1501-1570 are Hepatitis E virus probes
SEQ ID NOs: 1571-1580 are White clover cryptic virus 1 probes
SEQ ID NOs: 1581-1620 are Broad bean wilt virus 1 probes
SEQ ID NOs: 1621-1690 are Lettuce necrotic yellows virus probes
SEQ ID NOs: 1691-1700 are Zika virus isolate Brazil-ZKV2015 probes
SEQ ID NOs: 1701-1710 are Zika virus strain PRV-ABC59 probes
SEQ ID NOs: 1711-1720 are Zika virus isolate Z1106033 probes
SEQ ID NOs: 1721-1730 are Zika virus isolate SSABR1 probes
SEQ ID NOs: 1731-1769 are Zika virus strain ZikaSPH2015 probes
SEQ ID NOs: 1770-1852 are Cytomegalovirus probes
SEQ ID NOs: 1853-1917 are Epstein Barr virus B95-8 probes
SEQ ID NOs: 1918-2023 are Epstein Barr virus AG876 probes
SEQ ID NOs: 2024-2108 are Human herpesvirus 8 probes
SEQ ID NOs: 2109-2192 are Human papillomavirus subtype 6b probes
SEQ ID NOs: 2193-2271 are Human papillomavirus subtype 11 probes
SEQ ID NOs: 2272-2342 are Human papillomavirus subtype 16 probes
SEQ ID NOs: 2343-2419 are Human papillomavirus subtype 18 probes
SEQ ID NOs: 2420-2470 are Hepatitis B virus subtype adw probes
SEQ ID NOs: 2471-2520 are Hepatitis B virus subtype ayw probes
SEQ ID NOs: 2521-2556 are Hepatitis B virus subtype adr probes
SEQ ID NOs: 2557-2602 are Hepatitis B virus subtype ayr probes
SEQ ID NOs: 2603-2647 are Human parvovirus B19 probes
SEQ ID NOs: 2648-2751 are *Treponema pallidum* probes
SEQ ID NOs: 2752-2852 are *Ehrlichia chaffeensis* probes
SEQ ID NOs: 2853-2861 are *Ehrlichia ewingii* probes
SEQ ID NOs: 2862-2922 are *Ehrlichia muris* probes
SEQ ID NOs: 2923-3001 are *Borrelia burgdorferi* probes
SEQ ID NOs: 3002-3085 are *Coxiella burnetii* probes
SEQ ID NOs: 3086-3097 are *Trypanosoma brucei* probes
SEQ ID NO: 3098 is a *Trypanosoma cruzi* probe
SEQ ID NOs: 3099-3113 are *Leishmania major* probes
SEQ ID NOs: 3114-3154 are *Babesia microti* probes
SEQ ID NOs: 3155-3185 are *Plasmodium falciparum* probes
SEQ ID NOs: 3186-3207 are *Plasmodium vivax* probes
SEQ ID NOs: 3208-3301 are human ACTB probes
SEQ ID NOs: 3302-3385 are human ARL1 probes
SEQ ID NOs: 3386-3519 are human CCDN1 probes
SEQ ID NOs: 3520-3557 are *Aedes albopictus* densovirus 2 probes
SEQ ID NOs: 3558-3598 are Maize streak virus probes
SEQ ID NOs: 3599-3628 are Tomato pseudo-curly top virus probes

DETAILED DESCRIPTION

Disclosed herein are customized sets of probes, including microarray-based pathogen chips, for simultaneous detection of nucleic acids from RNA viruses, DNA viruses, and/or bacteria or protozoan pathogens in blood samples (such as human plasma) that are designed to have the flexibility to expand to detect emerging agents in a relatively short time frame. The presence of multiple probes per target represents an advantage in comparison to traditional NAT or EIA assays since the pathogen(s) can be detected even in the case of failure of one of the probes due to mutation (Petrik *Vox Sanguinis* 80:1-11, 2001). The flexibility and high-throughput capability of microarrays hold great potential for pathogen detection and identification, but historically have had limitations in detecting the presence of the low viral levels (Chen et al., *J. Vis. Exp.* 50:e2536, 2011; Wang et al., *Proc. Natl. Acad. Sci. USA* 99:15687-15692, 2002; Eckburg et al., *Clin. Infect. Dis.* 43:e71-e76, 2006). Disclosed herein are probe sets and microarray assays that include: 1) a platform design that simultaneously detects and distinguishes multiple pathogens and closely related strains or subtypes; and 2) a combination of amplification and labeling protocols to detect multiple targets present at low levels in a sample.

I. Terms

Unless otherwise noted, technical terms are used according to conventional usage. Definitions of common terms in molecular biology may be found in *Lewin's Genes X*, ed. Krebs et al., Jones and Bartlett Publishers, 2009 (ISBN 0763766321); Kendrew et al. (eds.), *The Encyclopedia of Molecular Biology*, published by Blackwell Publishers, 1994 (ISBN 0632021829); Robert A. Meyers (ed.), *Molecular Biology and Biotechnology: a Comprehensive Desk Reference*, published by Wiley, John & Sons, Inc., 1995 (ISBN 0471186341); and George P. Rédei, *Encyclopedic Dictionary of Genetics, Genomics, Proteomics and Informatics*, 3$^{rd}$ Edition, Springer, 2008 (ISBN: 1402067534), and other similar references.

Unless otherwise explained, all technical and scientific terms used herein have the same meaning as commonly understood by one of ordinary skill in the art to which this disclosure belongs. The singular terms "a," "an," and "the" include plural referents unless the context clearly indicates otherwise. Similarly, the word "or" is intended to include "and" unless the context clearly indicates otherwise. Hence "comprising A or B" means including A, or B, or A and B. It is further to be understood that all base sizes or amino acid sizes, and all molecular weight or molecular mass values, given for nucleic acids or polypeptides are approximate, and are provided for description.

Although methods and materials similar or equivalent to those described herein can be used in the practice or testing of the present disclosure, suitable methods and materials are described below. All publications, patent applications, patents, and other references mentioned herein are incorporated by reference in their entirety. In case of conflict, the present specification, including explanations of terms, will control. In addition, the materials, methods, and examples are illustrative only and not intended to be limiting.

In order to facilitate review of the various embodiments of the disclosure, the following explanations of specific terms are provided:

Array or Microarray: An arrangement of nucleic acids (such as DNA or RNA) or proteins (such as antibodies) in assigned locations on a matrix or substrate. In some examples, the nucleic acid molecules or proteins are attached covalently to the matrix or substrate.

*Babesia*: A tick-borne protozoan parasite that infects vertebrate red blood cells. In humans, *Babesia* species may cause asymptomatic infection or babesiosis, characterized by flu-like symptoms. Most cases of transmission between humans are attributed to a tick vector; however, it may also be transmitted through blood transfusion or organ donation. The most common pathogenic species in humans are *Babesia divergens* and *Babesia* microti. *Babesia* sequences are publicly available, and include GenBank Accession Nos. ASM107745v2 (*Babesia divergens*) and ASM69194v2 and ASM165006v1 (*Babesia microti*), which are incorporated by reference in their entirety as present in GenBank on Jan. 30, 2020.

*Borrelia*: A genus of tick-borne spirochete bacteria that cause Lyme disease. The major species of *Borrelia* that cause Lyme disease include *Borrelia burgdorferi*, *Borrelia afzelii*, *Borrelia garinii*, and *Borrelia mayonii*. *Borrelia* has been identified in blood stored for donation, though there is currently no evidence of Lyme disease linked to blood transfusion. *Borrelia* sequences are publicly available, and include GenBank Accession Nos. ASM868v2 (*Borrelia burgdorferi*), ASM30473v1 (*Borrelia afzelii*), ASM192254v1 (*Borrelia garinii*), and ASM194566v1 (*Borrelia mayonii*), which are incorporated by reference in their entirety as present in GenBank on Jan. 30, 2020).

Chikungunya virus (CHIKV): A positive-sense single-stranded RNA virus of the alphavirus genus in the family Togaviridae. This virus is primarily transmitted by *Aedes* mosquitoes, particularly *A. albopictus* and *A. aegypti*. The symptoms of CHIKV infection include rash, high fever and joint pain. CHIKV was first isolated in Tanzania in 1952 and re-emerged in Kenya in 2004. The evolution and spread of this virus into new geographic areas, and the disease severity resulting from CHIKV infection, present a serious public health concern. CHIKV sequences are publicly available, and include GenBank Accession No. NC_004162 (gi|27754751)), which is incorporated by reference in its entirety as present in GenBank on Jan. 30, 2019.

*Coxiella burnetii*: A Gram-negative bacteria that causes Q fever. Symptoms are typically flu-like and may be mild or severe, and a small percentage of infected individuals develop chronic Q fever. The bacteria infects livestock (such as cows, sheep, and goats) and is transmitted to humans by contact with feces, urine, milk, or other products from an infected animal, typically by breathing dust contaminated with the bacteria. *Coxiella burnetii* sequences are publicly available, and includes GenBank Accession No. ASM776v2, which is incorporated by reference in its entirety as present in GenBank on Jan. 30, 2020.

Cytomegalovirus (CMV): Also known as human herpesvirus 5. A common virus that infects up to 50% of adults by the age of 40. Most people show no symptoms of infection or only mild symptoms; however, babies born with congenital CMV infection may have long-term health problems. CMV is transmitted by body fluids, including blood transfusions. CMV sequences are publicly available, and include GenBank Accession No. NC_006273, which is incorporated by reference in its entirety as present in GenBank on Jan. 30, 2020.

Dengue virus (DEN): An RNA virus of the family Flaviviridae, genus *Flavivirus*. There are four serotypes of dengue virus, referred to as DEN1, DEN2, DEN3 and DEN4. All four serotypes can cause the full spectrum of dengue disease. Infection with one serotype can produce lifelong immunity to that serotype. However, severe complications can occur upon subsequent infection by a different serotype. Dengue virus is primarily transmitted by *Aedes* mosquitoes, particularly *A. aegypti*. Symptoms of dengue virus infection include fever, headache, muscle and joint pain and a skin rash similar to measles. In a small percentage of cases, the infection develops into a life-threatening dengue hemorrhagic fever, typically resulting in bleeding, low platelet levels and blood plasma leakage, or into dengue shock syndrome, characterized by dangerously low blood pressure. DEN sequences are publicly available, and include GenBank Accession Nos. NC_001477 (gi|9626685) (DEN1), NC_001474 (gi|158976983) (DEN2), NC_001475 (gi|163644368) (DEN3), and NC_002640 (gi|12084822) (DEN4), which are incorporated by reference in their entirety as present in GenBank on Jan. 30, 2019.

Epstein-Barr virus (EBV): Also known as human herpesvirus 4. EBV is a common virus that is spread primarily through saliva, though it can also be spread by sexual contact, blood transfusion, and organ transplantation. EBV causes infectious mononucleosis, characterized by fatigue, fever, swollen lymph nodes, and sore throat; however, EBV infection may also be asymptomatic. EBV sequences are publicly available, and include GenBank Accession Nos. AJ278309 (EBV strain B95-8), DQ279927 (EBV strain AG876), and NC_009334, all of which are incorporated by reference in their entirety as present in GenBank on Jan. 30, 2020.

*Ehrlichia*: A genus of tick-borne bacteria that causes ehrlichiosis. In some cases, *Ehrlichia* has been transmitted through blood transfusion or organ transplantation. Symptoms can include rash, fever, headache, muscle aches, nausea, vomiting, and diarrhea. Severe, late stage illness can include neural damage, respiratory failure, and organ failure. Disease causing species include *Ehrlichia chaffeensis*, *Ehrlichia ewingii*, and *Ehrlichia muris*. *Ehrlichia* sequences are publicly available, and include GenBank Accession Nos. NC_007799 (*E. chaffeensis*) and NC_023063 (*E. muris*), which are incorporated by reference in their entirety as present in GenBank on Jan. 30, 2020.

Hepatitis A virus (HAV): A single-stranded RNA virus in the order Picornavirales, family Picornaviridae. The virus is transmitted through fecal-oral and blood routes. HAV causes symptoms such as nausea, vomiting, diarrhea, jaundice, fever, and abdominal pain and typically lasts about 8 weeks. Acute liver failure may occur in some cases. HAV sequences are publicly available, and include GenBank Accession No. NC_001489 (gi|9626732), which is incorporated by reference in its entirety as present in GenBank on Jan. 30, 2019.

Hepatitis B virus (HBV): A DNA virus of the Hepadnaviridae family. HBV is transmitted through blood or bodily fluids and new infections are frequently asymptomatic in healthy adults.

Immunosuppressed adults and children less than 5 years of age more commonly exhibit symptoms, including flu-like symptoms and jaundice. HBV sequences are publicly available and include GenBank Accession Nos. AY518556 (subtype adw), NC_003977 (subtype ayw), AY123041 (subtype adr), and X04615 (subtype ayr), all of which are incorporated by reference in their entirety as present in GenBank on Jan. 30, 2020.

Hepatitis C virus (HCV): A single-stranded positive sense RNA virus of the family Flaviviridae. HCV is transmitted primarily through blood and acute infection typically causes mild or no symptoms. However, chronic infection frequently leads to liver disease, including cirrhosis, liver failure, and/or hepatocellular carcinoma. HCV type 1 sequences are publicly available, and include GenBank Accession No. NC_004102 (gi|22129792). HCV type 2 sequences are also publicly available, and include GenBank Accession No. NC_009823 (gi|157781212). HCV type 3 sequences are also publicly available, and include GenBank Accession No. NC_009824 (gi|157781216). Each of these sequences are incorporated by reference in their entirety as present in GenBank on Jan. 30, 2019.

Hepatitis E virus (HEV): A single-stranded positive sense RNA virus that is currently classified in the Hepeviridae family, genus *Orthohepevirus*. HEV causes liver inflammation, and is typically an acute and self-limiting infection. However, it can cause chronic hepatitis in individuals with weakened immune systems, particularly organ transplant recipients. HEV sequences are publicly available, and include GenBank Accession No. NC_001434 (gi|9626440), which is incorporated by reference in its entirety as present in GenBank on Jan. 30, 2019.

Human Immunodeficiency virus (HIV): A single-stranded positive-sense RNA virus (retrovirus) that causes HIV infection and acquired immunodeficiency syndrome (AIDS). HIV is transmitted by blood or sexual contact. HIV type 1 sequences are publicly available, and include GenBank Accession No. NC_001802 (gi|9629357). HIV type 2 sequences are also publicly available and include GenBank Accession No. NC_001722 (gi|9628880). Each sequence is incorporated by reference in their entirety as present in GenBank on Jan. 30, 2019.

Human Herpesvirus 8 (HHV-8): Also known as Kaposi sarcoma-associated herpesvirus. HHV-8 is associated with Kaposi sarcoma and other cancers, including some lymphomas. It is transmitted through bodily fluids, including blood, saliva, and sexual contact. HHV-8 sequences are publicly available and include GenBank Accession No. NC_009333, which is incorporated by reference in its entirety as present in GenBank on Jan. 30, 2020.

Human parvovirus: A single-stranded DNA virus of the Parvoviridae family. Parvovirus B19 is the only parvovirus known to infect humans. B19 primarily causes disease in children, and causes what is sometimes called "fifth disease," a mild rash. Parvovirus B19 can be transmitted via respiratory secretions or through blood or blood products. Human parvovirus B19 sequences are publicly available and include GenBank Accession No. NC_000883, which is incorporated by reference in its entirety as present in GenBank on Jan. 30, 2020.

Human papillomavirus (HPV): A DNA virus of the family Papillomaviridae. HPV is a common sexually transmitted virus that can cause warts and cancers, including cervical cancer and head and neck cancer, in some individuals. HPV DNA can be detected in the blood in some cases; however, it is not clear whether it can be transmitted by blood transfusion. There are over 100 known types of HPV to date. HPV sequences are publicly available, and include GenBank Accession Nos. HG793809 (type 6), HE574701 (type 11), NC_001526 (type 16), and NC_001357 (type 18), each of which are incorporated by reference in their entirety as present in GenBank on Jan. 30, 2020.

Human T-lymphotropic virus (HTLV): A group of positive-sense RNA retroviruses that are implicated in cancer (for example, T-cell lymphomas) and myelopathy. HTLV type I sequences are publicly available, and include GenBank Accession Nos. AF033817 and NC_001436 (gi|9626453). HTLV type II sequences are also publicly available and include GenBank Accession No. NC_001488 (gi|9626726). Each sequence is incorporated by reference in their entirety as present in GenBank on Jan. 30, 2019.

*Leishmania major*: A trypanosomatid parasite transmitted by sand flies. *L. major* causes cutaneous leishmaniosis. *L. major* sequences are publicly available, and include GenBank Accession No. ASM272v2, incorporated by reference in its entirety as present in GenBank on Jan. 30, 2020.

*Plasmodium*: A genus of mosquito-transmitted protozoan parasites that causes malaria in humans. The two major malaria causing *Plasmodium* species in humans are *P. falciparum* and *P. vivax*. *P. falciparum* is also associated with Burkitt's lymphoma. *Plasmodium* can be transmitted by blood transfusion, causing transfusion-transmitted malaria. *Plasmodium* sequences are publicly available and include GenBank Accession No. ASM276v2 (*P. falciparum*) and ASM241v2 (*P. vivax*), which are incorporated by reference in their entirety as present in GenBank on Jan. 30, 2020.

Probe: A probe typically comprises an isolated nucleic acid (for example, at least 10 or more nucleotides in length, such as 10-60, 15-50, 20-40, 20-50, 25-50, or 30-60 nucleotides in length). In some examples, a probe includes a detectable label, while in other examples a probe does not include a detectable label.

Sample (or biological sample): A biological specimen containing nucleic acids (for example, DNA, RNA, and/or mRNA), proteins, or combinations thereof, obtained from a subject. Examples include, but are not limited to, peripheral blood, serum, plasma, urine, saliva, tissue biopsy, fine needle aspirate, surgical specimen, and autopsy material. In some examples, a sample includes blood, serum, or plasma.

Subject: A living multi-cellular vertebrate organism, a category that includes human and non-human mammals. In one example, a subject is a blood donor.

*Treponema*: A genus of spirochete bacteria. The major pathogenic species in humans is *Treponema pallidum*, of which subspecies *T. pallidum pallidum* causes syphilis. The bacteria is transmitted primarily by sexual contact. Nucleic acid sequences for *T. pallidum pallidum* are publicly available and include GenBank Accession Nos. NC_016844 and NC_00919, which are incorporated by reference in their entirety as present in GenBank on Jan. 30, 2020.

*Trypanosoma*: A genus of protozoan parasites transmitted by blood-feeding insects. *T. brucei* is transmitted by infected tsetse flies and causes sleeping sickness (trypanosomiasis) in humans. There are two types of trypanosomiasis: East African trypanosomiasis, caused by *Trypanosoma brucei rhodesiense* and West African trypanosomiasis, caused by *Trypanosoma brucei gambiense*. *Trypanosoma brucei brucei* infects primarily cattle, and does not normally infect humans. *T. cruzi* causes Chagas disease and is transmitted by triatomine bugs. *Trypanosoma* sequences are publicly available and include GenBank Accession Nos. ASM21029v1 (*T. brucei* gambiense), and ASM20906v1 (*T. cruzi*), each of which are incorporated by reference in their entirety as present in GenBank on Jan. 30, 2020.

West Nile virus (WNV): A member of the virus family Flaviviridae and the genus *Flavivirus*. WNV was first isolated from a woman in the West Nile district of Uganda in 1937. The virus was later identified in birds in the Nile delta region in 1953. Human infections attributable to WNV have been reported in many countries for over 50 years. In 1999, a WNV circulating in Israel and Tunisia was imported into New York, producing a large and dramatic outbreak that spread throughout the continental United States in the following years. Human infection is most often the result of bites from infected mosquitoes, but may also be transmitted through contact with other infected animals, their blood or other tissues. Infection with WNV is asymptomatic in about 80% of infected people, but about 20% develop West Nile fever. Symptoms include fever, headache, fatigue, body aches, nausea, vomiting, swollen lymph glands and in some cases, a skin rash. Approximately 1 in 150 of infected individuals develop severe, neuroinvasive disease, such as encephalitis, meningitis, or poliomyelitis. WNV sequences are publicly available, and include GenBank Accession Nos. NC_009942 (gi|158516887) (NY99, lineage 1) and NC_001563 (gi|11528013) (956, lineage 2), which are incorporated by reference in their entirety as present in GenBank on Jan. 30, 2019.

Zika virus (ZKV or ZIKV): A member of the virus family Flaviviridae and the genus *Flavivirus*. ZIKV is spread by the daytime-active mosquitoes *Aedes aegypti* and *A. albopictus*. This virus was first isolated from a Rhesus macaque from the Zika Forest of Uganda in 1947. Since the 1950s, ZIKV has been known to occur within a narrow equatorial belt from Africa to Asia. The virus spread eastward across the Pacific Ocean in 2013-2014, resulting in ZIKV outbreaks in Oceania to French Polynesia, New Caledonia, the Cook islands, and Easter Island. In 2015, ZKV spread to Mexico, Central America, the Caribbean and South America, where ZKV has reached pandemic levels. Infection by ZIKV generally causes either no symptoms or mild symptoms, including mild headache, maculopapular rash, fever, malaise, conjunctivitis and joint pain. However, ZKV infection has been linked to the birth of microcephalic infants following maternal infection. Reports have also indicated that ZIKV has the potential for human blood-borne and sexual transmission. ZIKV sequences are publicly available, and include GenBank Accession Nos. KU497555 (gi|985578255) (isolate Brazil-ZK2015), KU501215 (gi|984874581) (strain PRV-ABC59), KU312312 (gi|973447404) (isolate Z1106033), KU707826 (gi|992324757) (isolate SSABR1), and KU321639 (strain ZikaSPH2015), which are incorporated by reference in their entirety as present in GenBank on Jan. 30, 2019.

II. Probes and Microarrays

Disclosed herein is a nucleic acid probe set capable of detecting nucleic acid molecules from one or more RNA viruses, including Chikungunya virus (CHIKV), Dengue virus types 1, 2, 3, or 4, (DEN1, DEN2, DEN3, DEN4), Hepatitis A virus (HAV), Hepatitis C virus (HCV) types 1, 2, or 3, Hepatitis E virus (HEV), Human Immunodeficiency virus (HIV) types 1 or 2, Human T-lymphotropic virus (HTLV) types I or II, West Nile virus (WNV), and Zika virus (ZKV). In some embodiments, the probe set includes 30 or more probes for one or more of the viruses (such as 30 or more, 50 or more, 60 or more, 70 or more, 80 or more, 90 or more, 100 or more, 110 or more, or 120 or more), for example 30-120 probes, 50-100 probes, or 70-110 probes for one or more of CHIKV, DEN1, DEN2, DEN3, DEN4, HAV, HCV type 1, HCV type 2, HCV type 3, HEV, HIV type 1, HIV type 2, HTLV type 1, HTLV type 2, WNV, and ZIKV.

In some embodiments, the probe set includes nucleic acid probes that are at least 80%, at least 90%, at least 95%, at least 96%, at least 97%, at least 98%, at least 99%, or 100% identical to the nucleic acid sequences of SEQ ID NOs: 1-1300, 1391-1570, and 1691-1769. In other embodiments, the probe set includes a subset of the probes of SEQ ID NOs: 1-1300, 1391-1570, and 1691-1769, such as at least 10%, at least 20%, at least 30%, at least 40%, at least 50%, at least 60%, at least 70%, at least 80%, at least 90%, at least 95%, at least 96%, at least 97%, at least 98%, at least 99%, or at least 99.9% of the probes of SEQ ID NOs: 1-1300, 1391-1570, and 1691-1769. In some examples, the subset includes at least one probe for each of CHIKV, DEN1, DEN2, DEN3, DEN4, HAV, HCV type 1, HCV type 2, HCV type 3, HEV, HIV type 1, HIV type 2, HTLV type 1, HTLV type 2, WNV, and ZKV, such as at least 1, at least 2, at least 5, at least 10, at least 20, at least 30, or more probes for each virus. In some examples, the subset includes at least 40 probes (such as at least 50, at least 60, at least 70, at least 80, at least 90, at least 100, or at least 110 probes) for one or more of CHIKV, DEN1, DEN2, DEN3, DEN4, HAV, HCV type 1, HCV type 2, HCV type 3, HEV, HIV type 1, HIV type 2, HTLV type 1, HTLV type 2, WNV, and ZKV.

In one non-limiting example, the probe set includes or consists of each of the probes of SEQ ID NOs: 1-1769. In another non-limiting example, the probe set includes or consists of each of the probes of SEQ ID NOs: 1-1300, 1391-1570, and 1691-1769. In another example, the probe set includes or consists of each of the probes of SEQ ID NOs: 1-1300 and 1391-1769. In other embodiments, the probe set includes a subset of the probes of SEQ ID NOs: 1-1300, 1391-1570, and 1691-1769 or a subset of the probes of SEQ ID NOs: 1-1300 and 1391-1769.

Also disclosed herein is a nucleic acid probe set capable of detecting nucleic acid molecules from one or more DNA viruses, including one or more of cytomegalovirus, Epstein Barr virus (e.g., one or more of EBV subtype B95-8 and EBV subtype AG876), human herpes virus 8, Hepatitis B virus (e.g., one or more of HBV subtypes adw, ayw, adr, and ayr), human parvovirus B19, and human papillomavirus (e.g., one or more of HPV types 6, 11, 16, and 18). In some embodiments, the probe set includes 10 or more probes for one or more of the viruses (such as 15 or more, 20 or more, 30 or more, 50 or more, 60 or more, 70 or more, 80 or more, 90 or more, 100 or more, 110 or more, or 120 or more), for example 10-50 probes, 30-120 probes, 50-100 probes, or 70-110 probes for one or more of cytomegalovirus, Epstein Barr virus, human herpes virus 8, Hepatitis B virus, human parvovirus B19, and human papillomavirus.

In some embodiments, the probe set includes nucleic acid probes that are at least 80%, at least 90%, at least 95%, at least 96%, at least 97%, at least 98%, at least 99%, or 100% identical to the nucleic acid sequences of SEQ ID NOs: 1770-2647. In other embodiments, the probe set includes a subset of the probes of SEQ ID NOs: 1770-2647, such as at least 10%, at least 20%, at least 30%, at least 40%, at least 50%, at least 60%, at least 70%, at least 80%, at least 90%, at least 95%, at least 96%, at least 97%, at least 98%, at least 99%, or at least 99.9% of the probes of SEQ ID NOs: 1770-2647. In some examples, the subset includes at least one probe for each of CMV, EBV subtype B95-8, EBV subtype AG876, human herpes virus 8, Hepatitis B virus subtype adw, Hepatitis B virus subtype ayw, Hepatitis B virus subtype adr, Hepatitis B virus subtype ayr, human parvovirus B19, HPV type 6, HPV type 11, HPV type 16, and HPV type 18, such as at least 1, at least 2, at least 5, at least 10, at least 20, at least 30, or more probes for each virus. In some examples, the subset includes at least 10 probes (such as at least 20, at least 30, at least 40, at least 50, at least 60, at least 70, at least 80, at least 90, at least 100, or at least 110 probes) for one or more of CMV, EBV subtype B95-8, EBV subtype AG876, human herpes virus 8, Hepatitis B virus subtype adw, Hepatitis B virus subtype ayw, Hepatitis B virus subtype adr, Hepatitis B virus subtype ayr, human parvovirus B19, HPV type 6, HPV type 11, HPV type 16, and HPV type 18. In one non-limiting example, the probe set includes or consists of each of the probes of SEQ ID NOs: 1770-2647.

Further disclosed herein is a nucleic acid probe set capable of detecting nucleic acid molecules from one or more bacterial and/or protozoan pathogens, including one or more of *Treponema pallidum, Ehrlichia chaffeensis, Ehrlichia ewingii, Ehrlichia muris, Borrelia burgdorferi, Coxiella burnetii, Trypanosoma brucei, Trypanosoma cruzi, Leishmania major, Babesia microti, Plasmodium falciparum*, and *Plasmodium vivax*. In some embodiments, the probe set includes 10 or more probes for one or more of the viruses (such as 10 or more, 20 or more, 30 or more, 50 or more, 60 or more, 70 or more, 80 or more, 90 or more, 100 or more, 110 or more, or 120 or more), for example 30-120 probes, 50-100 probes, or 70-110 probes for one or more of *Treponema pallidum, Ehrlichia chaffeensis, Ehrlichia ewingii, Ehrlichia muris, Borrelia burgdorferi, Coxiella burnetii, Trypanosoma brucei, Leishmania major, Babesia microti, Plasmodium falciparum*, and *Plasmodium vivax*

In some embodiments, the probe set includes nucleic acid probes that are at least 80%, at least 90%, at least 95%, at least 96%, at least 97%, at least 98%, at least 99%, or 100% identical to the nucleic acid sequences of SEQ ID NOs: 2648-3207. In other embodiments, the probe set includes a subset of the probes of SEQ ID NOs: 2648-3207, such as at least 10%, at least 20%, at least 30%, at least 40%, at least 50%, at least 60%, at least 70%, at least 80%, at least 90%, at least 95%, at least 96%, at least 97%, at least 98%, at least 99%, or at least 99.9% of the probes of SEQ ID NOs: 2648-3207. In some examples, the subset includes at least one probe for each of *Treponema pallidum, Ehrlichia chaffeensis, Ehrlichia ewingii, Ehrlichia muris, Borrelia burgdorferi, Coxiella burnetii, Trypanosoma brucei, Trypanosoma cruzi, Leishmania major, Babesia microti, Plasmodium falciparum*, and *Plasmodium vivax*, such as at least 1, at least 2, at least 5, at least 10, at least 20, at least 30, or more probes for each pathogen. In some examples, the subset includes at least 10 probes (such as at least 20, at least 30, at least 50, at least 60, at least 70, at least 80, at least 90, at least 100, or at least 110 probes) for one or more of *Treponema pallidum, Ehrlichia chaffeensis, Ehrlichia ewingii, Ehrlichia muris, Borrelia burgdorferi, Coxiella burnetii, Trypanosoma brucei, Leishmania major, Babesia microti, Plasmodium falciparum*, and *Plasmodium vivax*. In one non-limiting example, the probe set includes or consists of each of the probes of SEQ ID NOs: 2648-3207.

In further embodiments, one or more of the disclosed probe sets are combined. Thus, some embodiments, the probe set includes probes for detecting at least one RNA virus, at least one DNA virus, at least one bacterial pathogen, at least one protozoan pathogen, or combinations of two or more thereof. In one example, a probe set includes probes capable of detecting nucleic acid molecules from one or more DNA viruses and one or more bacterial and/or protozoan pathogens. In one non-limiting example, a probe set includes probes including or consisting of each of the probes of SEQ ID NOs: 1770-3207. In another example, a probe set includes probes capable of detecting nucleic acid molecules from one or more RNA viruses, one or more DNA viruses, and one or more bacterial and/or protozoan pathogens. In a non-limiting example, the probe set includes probes including or consisting of each of the probes of SEQ ID NOs: 1-1300, SEQ ID NOs: 1391-1570, SEQ ID NOs: 1691-1769, and SEQ ID NOs: 1770-3207.

In additional embodiments, a disclosed probe set further includes one or more control probes, such as one or more positive and/or negative control probes. For testing for validity of the run, intra-array reproducibility control and normalization. positive control probes may include one or more of: 1) one or more reference probes for intensity normalization, 2) one or more internal standards of known concentrations, and 3) one or more probes that are homologous to an internal control included in the hybridization mix. In some embodiments, positive control probes include one or more (such as 1, 10, 25, 50, 96, or more) ERCC probes (External RNA Controls Consortium) and one or more (such as 1, 10, 25, 50, 96, 250, 500, 900, or more) biological replicates targeting human genome sequences (for example, to define possible host contaminant).

Negative control probes may include one or more probes for a virus that is known not to be present in human or mammalian subjects. In some non-limiting examples, negative control probes are specific for a plant virus. In other examples, negative control probes can be a structural negative probe, such as a sequence that forms a hairpin and does not hybridize with nucleic acids from any species.

In some examples, the probe set includes at least 10, at least 20, at least 30, at least 40, at least 50, at least 60, at least 70, at least 80, at least 90, at least 100, at least 110, or at least 120 control probes. In some examples, the control probes are for one or more one or more different negative control viruses (such as 1, 2, 3, 4, 5, or more negative control viruses). In some examples, the probe set includes at least 10, at least 20, at least 30, at least 40, at least 50, at least 60, at least 70, at least 80, at least 90, at least 100, at least 110, at least 120, or more negative control probes. In some examples, the negative control probes are probes for one or more of White clover cryptic virus 1 (e.g. SEQ ID NOs: 1571-1580), Broad bean wilt virus 1 (e.g., SEQ ID NOs: 1582-1620), Lettuce necrotic yellows virus (e.g., SEQ ID NOs: 1621-1690), *Aedes albopictus* densovirus 2 (e.g., SEQ ID NOs: 3520-3557), Maize streak virus (e.g., SEQ ID NOs: 3558-3598), and/or Tomato pseudo-curly top virus (e.g., SEQ ID NOs: 3599-3628). In additional examples, the probe set includes at least 10, at least 20, at least 30, at least 40, at least 50, at least 60, at least 70, at least 80, at least 90, at least 100, at least 110, at least 120, or more positive control probes. In some examples, the positive control probes are probes for one or more housekeeping genes, such as one of more of ACTB (e.g., SEQ ID NOs: 3208-3301), ARL1 (e.g., SEQ ID NOs: 3302-3385), and/or CCDN1 (e.g., SEQ ID NOs: 3386-3519).

In some embodiments, the disclosed probes are between 30 and 80 nucleotides in length (for example 30-50, 40-60, 50-70, or 60-80 nucleotides in length). In some examples, the probes are 30, 35, 40, 45, 50, 55, 60, 65, 70, 75, or 80 nucleotides in length and are capable of hybridizing to the disclosed pathogen (e.g., viral, bacterial, or protozoan) nucleic acid molecules. In some examples, the probes are 60 nucleotides in length. In some examples, each of the probes in the probe set has a Tm between about 72-89° C., such as about 74-88° C., about 75-85° C., or about 76-82° C. In one specific example, each of the probes in the probe set has a Tm between 74.4 and 87.8° C. Tm ranges for exemplary RNA virus probes are shown in Table 1.

In other embodiments the disclosed probe sets, or a subset thereof, are linked to a solid support. In some examples, the disclosed probe sets, or a subset thereof, are included on a microarray. In other examples, the solid support is a bead or plurality of beads, a microplate, column, or microfluidic device.

In some embodiments, the microarray is a solid support or substrate including the probe set (or subset thereof) covalently linked to the support or substrate. Within an array, each arrayed probe is addressable, in that its location can be reliably and consistently determined within at least two dimensions of the array. Addressable arrays usually are computer readable, in that a computer can be programmed to correlate a particular address on the array with information about the sample at that position (such as hybridization or binding data, including for instance signal intensity).

The microarray can include any of the probe sets described above, individually, or in combination. In some embodiments, the microarray includes nucleic acid probes that are at least 80%, at least 90%, at least 95%, at least 96%, at least 97%, at least 98%, at least 99%, or 100% identical to the nucleic acid sequences of SEQ ID NOs: 1-1300, 1391-1570, and 1691-1769. In another embodiment, the microarray includes or consists of nucleic acid probes that are at least 80%, at least 90%, at least 95%, at least 96%, at least 97%, at least 98%, at least 99%, or 100% identical to the nucleic acid sequences of SEQ ID NOs: 1-1300 and 1391-1769. In one non-limiting example, the microarray includes or consists of each of the probes of SEQ ID NOs: 1-1769. In another non-limiting example, the microarray includes or consists of each of the probes of SEQ ID NOs: 1-1300, 1391-1570, and 1691-1769. In a further non-limiting example, the microarray includes or consists of each of the probes of SEQ ID NOs: 1-1300 and 1391-1769.

In another embodiment, the microarray includes nucleic acid probes that are at least 80%, at least 90%, at least 95%, at least 96%, at least 97%, at least 98%, at least 99%, or 100% identical to the nucleic acid sequences of SEQ ID NOs: 1770-2647. In one non-limiting example, the microarray includes or consists of each of the probes of SEQ ID NOs: 1770-2647. In another non-limiting example, the microarray includes or consists of each of the probes of SEQ ID NOs: 1170-2647 and 3250-3628.

In another embodiment, the microarray includes nucleic acid probes that are at least 80%, at least 90%, at least 95%, at least 96%, at least 97%, at least 98%, at least 99%, or 100% identical to the nucleic acid sequences of SEQ ID NOs: 2648-3207. In one non-limiting example, the microarray includes or consists of each of the probes of SEQ ID NOs: 2648-3207. In another non-limiting example, the microarray includes or consists of each of the probes of SEQ ID NOs: 2648-3519.

In a further embodiment, the microarray includes nucleic acid probes that are at least 80%, at least 90%, at least 95%, at least 96%, at least 97%, at least 98%, at least 99%, or 100% identical to the nucleic acid sequences of SEQ ID NOs: 1770-3207. In one non-limiting example, the microarray includes or consists of each of the probes of SEQ ID NOs: 1770-3207. In a further non-limiting example, the microarray includes or consists of each of the probes of SEQ ID NOs: 1770-3628.

In other embodiments, the microarray includes a subset of the probes of SEQ ID NOs: 1-1300, 1391-1570, and 1691-1769, such as at least 10%, at least 20%, at least 30%, at least 40%, at least 50%, at least 60%, at least 70%, at least 80%, at least 90%, at least 95%, at least 96%, at least 97%, at least 98%, at least 99%, or at least 99.9% of the probes of SEQ ID NOs: 1-1300, 1391-1570, and 1691-1769. In some examples, the microarray includes at least one probe for each of CHIKV, DEN1, DEN2, DEN3, DEN4, HAV, HCV type 1, HCV type 2, HCV type 3, HEV, HIV type 1, HIV type 2, HTLV type 1, HTLV type 2, WNV, and ZKV, such as at least 1, at least 2, at least 5, at least 10, at least 20, at least 30, or more probes for each virus. In some examples, the microarray includes at least 40 probes (such as at least 50, at least 60, at least 70, at least 80, at least 90, at least 100, or at least 110 probes) for one or more of CHIKV, DEN1, DEN2, DEN3, DEN4, HAV, HCV type 1, HCV type 2, HCV type 3, HEV, HIV type 1, HIV type 2, HTLV type 1, HTLV type 2, WNV, and ZKV.

In other embodiments, the microarray includes a subset of the probes of SEQ ID NOs: 1770-2647, such as at least 10%, at least 20%, at least 30%, at least 40%, at least 50%, at least 60%, at least 70%, at least 80%, at least 90%, at least 95%, at least 96%, at least 97%, at least 98%, at least 99%, or at least 99.9% of the probes of SEQ ID NOs: 1770-2647. In some examples, the microarray includes at least one probe for each of CMV, EBV subtype B95-8, EBV subtype AG876, human herpes virus 8, Hepatitis B virus subtype adw, Hepatitis B virus subtype ayw, Hepatitis B virus subtype adr, Hepatitis B virus subtype ayr, human parvovirus B19, HPV type 6, HPV type 11, HPV type 16, and HPV type 18, such as at least 1, at least 2, at least 5, at least 10, at least 20, at least 30, or more probes for each virus. In some examples, the microarray includes at least 20 probes (such as at least 40, at least 50, at least 60, at least 70, at least 80, at least 90, at least 100, or at least 110 probes) for one or more of CMV, EBV subtype B95-8, EBV subtype AG876, human herpes virus 8, Hepatitis B virus subtype adw, Hepatitis B virus subtype ayw, Hepatitis B virus subtype adr, Hepatitis B virus subtype ayr, human parvovirus B19, HPV type 6, HPV type 11, HPV type 16, and HPV type 18.

In other embodiments, the microarray includes a subset of the probes of SEQ ID NOs: 2648-3207, such as at least 10%, at least 20%, at least 30%, at least 40%, at least 50%, at least 60%, at least 70%, at least 80%, at least 90%, at least 95%, at least 96%, at least 97%, at least 98%, at least 99%, or at least 99.9% of the probes of SEQ ID NOs: 2648-3207. In some examples, the microarray includes at least one probe for each of *Treponema pallidum, Ehrlichia chaffeensis, Ehrlichia ewingii, Ehrlichia muris, Borrelia burgdorferi, Coxiella burnetii, Trypanosoma brucei, Trypanosoma cruzi, Leishmania major, Babesia microti, Plasmodium falciparum,* and *Plasmodium vivax,* such as at least 1, at least 2, at least 5, at least 10, at least 20, at least 30, or more probes for each virus. In some examples, the microarray includes at least 10 probes (such as at least 30, at least 30, at least 40, at least 50, at least 60, at least 70, at least 80, at least 90, at least 100, or at least 110 probes) for one or more of *Treponema pallidum, Ehrlichia chaffeensis, Ehrlichia ewingii, Ehrlichia muris, Borrelia burgdorferi, Coxiella burnetii, Trypanosoma brucei, Leishmania major, Babesia microti, Plasmodium falciparum,* and *Plasmodium vivax.*

In additional embodiments, the microarray includes one or more control probes, such as one or more positive and/or negative control probes. In some examples, the microarray includes at least 10, at least 20, at least 30, at least 40, at least 50, at least 60, at least 70, at least 80, at least 90, at least 100, at least 110, or at least 120 negative control probes. In some examples, the microarray includes one or more negative control probes selected from SEQ ID NOs: 1571-1580, SEQ ID NOs: 1582-1620, SEQ ID NOs: 1621-1690, and SEQ ID NOs: 3520-3628. In additional examples, the microarray includes at least 10, at least 20, at least 30, at least 40, at least 50, at least 60, at least 70, at least 80, at least 90, at least 100, at least 110, or at least 120 positive control probes. In some examples, the microarray includes one or more positive control probes selected from SEQ ID NOs: 3208-3519.

The solid support or substrate of the array can be formed from an organic polymer. Suitable materials for the solid support include, but are not limited to: polypropylene, polyethylene, polybutylene, polyisobutylene, polybutadiene, polyisoprene, polyvinylpyrrolidine, polytetrafluroethylene, polyvinylidene difluroide, polyfluoroethylene-propylene, polyethylenevinyl alcohol, polymethylpentene, polycholorotrifluoroethylene, polysulfornes, hydroxylated biaxially oriented polypropylene, aminated biaxially oriented polypropylene, thiolated biaxially oriented polypropylene, ethyleneacrylic acid, thylene methacrylic acid, and blends of copolymers thereof).

A wide variety of array formats can be employed in accordance with the present disclosure. One example includes a two-dimensional pattern of discrete cells (such as 4096 squares in a 64 by 64 array). Other array formats including, but not limited to slot (rectangular) and circular arrays are equally suitable for use. In some examples, the array is a multi-well plate. In one example, the array is formed on a polymer medium, which is a thread, membrane or film. An example of an organic polymer medium is a polypropylene sheet having a thickness on the order of about 1 mil. (0.001 inch) to about 20 mil., although the thickness of the film is not critical and can be varied over a fairly broad range. The array can include biaxially oriented polypropylene (BOPP) films, which in addition to their durability, exhibit low background fluorescence.

The array formats of the present disclosure can be included in a variety of different types of formats. A "format" includes any format to which the solid support can be affixed, such as microtiter plates (e.g., multi-well plates), test tubes, inorganic sheets, dipsticks, and the like. For example, membranes can be affixed to glass slides. The particular format is, in and of itself, unimportant. All that is necessary is that the solid support can be affixed thereto without affecting the functional behavior of the solid support or any biopolymer absorbed thereon, and that the format (such as the slide) is stable to any materials into which the device is introduced (such as clinical samples and hybridization solutions).

The arrays of the present disclosure can be prepared by a variety of approaches. In one example, oligonucleotides (e.g., probes) are synthesized separately and then attached to a solid support (see U.S. Pat. No. 6,013,789). In another example, probes are synthesized directly onto the support to provide the desired array (see U.S. Pat. No. 5,554,501). Suitable methods for covalently coupling oligonucleotides to a solid support and for directly synthesizing oligonucleotides on the support are known; a summary of suitable methods can be found in Matson et al., Anal. Biochem. 217:306-10, 1994. In one example, the oligonucleotides are synthesized onto the support using conventional chemical techniques for preparing oligonucleotides on solid supports (such as PCT applications WO 85/01051 and WO 89/10977, or U.S. Pat. No. 5,554,501).

The oligonucleotides can be bound to the support or substrate by either the 3' end of the oligonucleotide or by the 5' end of the oligonucleotide. In one example, the oligonucleotides are bound to the solid support by the 3' end. In general, the internal complementarity of an oligonucleotide probe in the region of the 3' end and the 5' end determines binding to the support.

III. Methods of Detecting Viral Nucleic Acids

Disclosed herein are methods of detecting one or more pathogen nucleic acids (such as one or more viral, bacterial, and/or protozoan nucleic acids) in a sample from a subject. In some embodiments, the methods include preparing or isolating nucleic acids (such as DNA, RNA, or cDNA) from a sample, labeling the nucleic acids, and contacting the probe set, or a microarray including the probe set, with the labeled nucleic acids under conditions sufficient to allow pathogen nucleic acids present in the sample to hybridize with one or more of the probes. The presence and/or identity of pathogen nucleic acids in the sample is determined by detecting hybridization. In one example, hybridization is detected by measuring presence of labeled nucleic acid at an addressable location in an array.

In particular embodiments, the methods include detecting one or more nucleic acids from RNA viruses in a sample, including one or more of CHIKV, DEN1, DEN2, DEN3, DEN4, HAV, HCV type 1, HCV type 2, HCV type 3, HEV, HIV type 1, HIV type 2, HTLV type I, HTLV type II, WNV, and ZKV. In other embodiments, the methods include detecting one or more nucleic acids from DNA viruses, including one or more of CMV, EBV subtype B95-8, EBV subtype AG876, human herpes virus 8, Hepatitis B virus subtype adw, Hepatitis B virus subtype ayw, Hepatitis B virus subtype adr, Hepatitis B virus subtype ayr, human parvovirus B19, HPV type 6, HPV type 11, HPV type 16, and HPV type 18. In still other embodiments, the methods include detecting one or more nucleic acids from bacteria and/or protozoans, including one or more of *Treponema pallidum, Ehrlichia chaffeensis, Ehrlichia ewingii, Ehrlichia muris, Borrelia burgdorferi, Coxiella burnetii, Trypanosoma brucei, Trypanosoma cruzi, Leishmania major, Babesia microti, Plasmodium falciparum*, and *Plasmodium vivax*. In further embodiments, the methods include detecting nucleic acids from at least one RNA virus, DNA virus, bacteria, and protozoan, such as at least one of the RNA viruses, DNA viruses, bacteria, and protozoans disclosed herein, or any combination thereof.

Exemplary samples include peripheral blood, serum, plasma, cerebrospinal fluid, urine, saliva, feces, mucus, nasal wash, tissue biopsy, fine needle aspirate, surgical specimen, placenta, autopsy material, semen, vaginal fluid or tissue, and environmental samples. In particular examples, the sample is a blood sample, such as plasma. In non-limiting examples, the sample is blood or plasma from a blood donor. Thus, in some examples, the methods disclosed herein are used to screen donated blood for one or more pathogens potentially present and/or transmitted through blood transfusions.

In some embodiments, the methods include isolating nucleic acids (such as RNA, cDNA, or a combination thereof) from the sample and contacting the probe set or microarray with the isolated nucleic acids. Methods of isolating RNA (e.g., viral RNA) from a sample are known and include commercially available kits, such as QIAGEN® RNeasy® mini-columns, MASTERPURE® Complete DNA and RNA Purification Kit (EPICENTRE® Madison, Wis.), Paraffin Block RNA Isolation Kit (Ambion, Inc.), and RNA Stat-60 (Tel-Test). cDNA is then prepared from the isolated RNA, and optionally labeled. In some examples, the methods include amplifying RNA prior to cDNA preparation and labeling, for example, using Quick Amp WT labeling kit (Agilent). Other methods of amplifying RNA include commercially available kits such as Ovation® RNA Amplification kit (Nugen), Arcturus™ RiboAmp™ HS kit (ThermoFisher), and Complete Whole Transcriptome Amplification Kit (WTA2, Sigma-Aldrich).

In some embodiments, the methods do not include isolating and/or amplifying RNA from a sample prior to labeling. In some examples, the methods include generating amplified cDNA from a sample, followed by labeling the cDNA (for example with a fluorescent label, such as Cy™3 dye). In one non-limiting example, amplified cDNA is prepared from the sample using single-primer isothermal amplification (for example, Ribo-SPIA® amplification, NuGen) prior to labeling. Methods of labeling cDNA are known and include commercially available kits, such as Genomic DNA Enzymatic Labeling Kit (Agilent). In some examples, the methods generate amplified and labeled cDNA from about 250 pg of target viral RNA (such as about 500 pg, about 750 pg, about 1 ng, about 2 ng, or more of target viral RNA).

In other examples, the methods include isolating DNA from the sample and contacting the probe set or microarray with the isolated DNA. Methods of isolating DNA (such as viral DNA, bacterial DNA, or protozoan DNA) from a sample are known and include commercially available kits. In some examples, the methods include isolating viral DNA from a sample using a viral nucleic acid isolation kit. In one non-limiting example, the viral DNA is isolated using Dynabeads™ SILANE viral NA kit (Invitrogen). In other examples, bacterial or protozoan DNA is isolated from a sample using a DNA isolation kit. In one non-limiting example, bacterial or protozoan DNA is isolated using QIAamp® DNA Blood Mini kit (Qiagen). One of ordinary skill in the art can select appropriate methods or kits to isolate pathogen DNA from samples, for example, blood or plasma samples.

The sample (such as nucleic acids isolated and/or amplified from a sample) can be labeled with any suitable label. Generally, the label will be selected based on the intended use of the sample or the desired readout. In some examples, the sample or nucleic acids from the sample is labelled with a fluorescent or chemiluminescent compound. In other examples, the label is an enzyme, a fluorophore, or a radioactive isotope. In one specific non-limiting example, the label is Cy™3 or Cy™ 5.

Fluorophores suitable for use with the methods disclosed herein, include, but are not limited to, 6-carboxyfluorescein (FAM), tetrachlorofluorescein (TET), tetramethylrhodamine (TMR), hexachlorofluorescein (HEX), JOE, ROX, CAL Fluor™ dye, Pulsar™ dye, Quasar™ dye, Texas Red™ dye, Cy™3 dye and Cy™5 dye. Other examples of fluorophores that can be used with the methods provided herein include 4-acetamido-4'-isothiocyanatostilbene-2,2'disulfonic acid; acridine and derivatives such as acridine and acridine isothiocyanate, 5-(2'-aminoethyl)amino-naphthalene-1-sulfonic acid (EDANS), 4-amino-N-[3-vinylsulfonyl)phenyl]-naphthalimide-3,5 disulfonate (Lucifer Yellow VS), N-(4-anilino-1-naphthyl)-maleimide, anthranilamide, Brilliant Yellow, coumarin and derivatives such as coumarin, 7-amino-4-methylcoumarin (AMC, Coumarin 120), 7-amino-4-trifluoromethylcouluarin (Coumaran 151); cyanosine; 4',6-diaminidino-2-phenylindole (DAPI); 5', 5"-dibromopyrogallol-sulfonephthalein (Bromopyrogallol Red); 7-diethylamino-3-(4'-isothiocyanatophenyl)-4-methylcoumarin; diethylenetriamine pentaacetate; 4,4'-diisothiocyanatodihydro-stilbene-2,2'-disulfonic acid; 4,4'-diisothiocyanatostilbene-2,2'-disulfonic acid; 5-[dimethyl-amino] naphthalene-1-sulfonyl chloride (DNS, dansyl chloride); 4-(4'-dimethyl-aminophenylazo)benzoic acid (DABCYL); 4-dimethylaminophenylazophenyl-4'-isothiocyanate (DABITC); eosin and derivatives such as eosin and eosin isothiocyanate; erythrosin and derivatives such as erythrosin B and erythrosin isothiocyanate; ethidium; fluorescein and derivatives such as 5-carboxyfluorescein (FAM), 5-(4,6-dichlorotriazin-2-yl)aminofluorescein (DTAF), 2'7'-dimethoxy-4'5'-dichloro-6-carboxyfluorescein (JOE), fluorescein, fluorescein isothiocyanate (FITC), and QFITC (XRITC); fluorescamine; IR144; IR1446; Malachite Green isothiocyanate; 4-methylumbelliferone; ortho cresolphthalein; nitrotyrosine; pararosaniline; Phenol Red; B-phycoerythrin; o-phthaldialdehyde; pyrene and derivatives such as pyrene, pyrene butyrate and succinimidyl 1-pyrene butyrate; Reactive Red 4 (Cibacron Brilliant Red 3B-A); rhodamine and derivatives such as 6-carboxy-X-rhodamine (ROX), 6-carboxyrhodamine (R6G), lissamine rhodamine B sulfonyl chloride, rhodamine (Rhod), rhodamine B, rhodamine 123, rhodamine X isothiocyanate, sulforhodamine B, sulforhodamine 101 and sulfonyl chloride derivative of sulforhodamine 101 (Texas Red™ dye); N,N,N',N'-tetramethyl-6-carboxyrhodamine (TAMRA); tetramethyl rhodamine; tetramethyl rhodamine isothiocyanate (TRITC); riboflavin; rosolic acid and terbium chelate derivatives.

Other fluorophores that can be used include thiol-reactive europium chelates that emit at approximately 617 nm (Heyduk and Heyduk, *Analyt. Biochem.* 248:216-27, 1997; *J. Biol. Chem.* 274:3315-22, 1999). Other fluorophores that can be used include cyanine, merocyanine, styryl, and oxonyl compounds, such as those disclosed in U.S. Pat. Nos. 5,627,027; 5,486,616; 5,569,587; and 5,569,766, and in published PCT application no. US98/00475, each of which is incorporated herein by reference. Specific examples of fluorophores disclosed in one or more of these patent documents include Cy™3 and Cy™5, for instance, and substituted versions of these fluorophores. Additional fluorophores that can be used include GFP, Lissamine™, diethylaminocoumarin, fluorescein chlorotriazinyl, naphthofluorescein, 4,7-dichlororhodamine and xanthene (as described in U.S. Pat. No. 5,800,996 to Lee et al., herein incorporated by reference) and derivatives thereof. Other fluorophores are commercially available from known sources.

The methods include contacting the sample (such as labeled nucleic acids from a sample) with a probe set disclosed herein (or subset thereof), or a microarray including the probe set (or subset thereof), under conditions sufficient to allow hybridization of pathogen nucleic acids present in the sample to one or more probes and detecting presence of pathogen nucleic acids hybridized to the probe set or microarray.

Presence of one or more pathogen nucleic acids in the sample can be detected using any suitable means. For example, detection of hybridization can be accomplished by detecting nucleic acid molecules (such as RNA) using nucleic acid amplification methods (such as real-time RT-PCR) or array analysis. In a specific embodiment of the microarray technique, labeled cDNA prepared from a sample is applied to an array including a probe set disclosed herein. Labeled cDNA from the sample can hybridize specifically to one or more probes on the array. After washing to remove non-specifically bound probes, the chip is scanned by confocal laser microscopy or by another detection method, such as a CCD camera. Quantitation of hybridization of sample to each arrayed element allows for assessment of corresponding RNA abundance (e.g., if cDNA is analyzed). Microarray analysis can be performed by commercially available equipment, following manufacturer's protocols, such as are supplied with Affymetrix GeneChip® technology (Affymetrix, Santa Clara, CA), or Agilent's microarray technology (Agilent Technologies, Santa Clara, CA).

In some examples, a sample is determined to contain nucleic acids from a particular pathogen by detecting hybridization between the sample (nucleic acid) and one or more probes of the pathogen-specific probe set. In some examples, a sample is determined to be positive for a pathogen when the log ratio between the signal intensity mean for the pathogen-specific probe set and the mean of a control group probe set is ≥1.5. In other examples, a sample is determined to be negative for a pathogen when the log ratio between the signal intensity mean for the pathogen-specific probe set and the mean of a control group probe set is <1. In further examples, the sample is determined to be borderline for the pathogen when the log ratio between the signal intensity mean for the pathogen-specific probe set and the mean of a control group probe set is ≥1.0 to ≤1.5. In some examples, a sample that is determined to be borderline for one or more pathogens is retested (for example, retested with the assay disclosed herein and/or tested using a virus-specific nucleic acid based test). In other examples, a sample that is determined to be borderline is discarded (e.g., not administered to a subject). In additional examples, a sample is determined to be positive for a particular pathogen when ≥50% of the individual probes for the particular pathogen have a log ratio of >1.5. In some examples, a sample is determined to be positive for a particular pathogen when ≥50% of the individual probes for the particular pathogen have a log ratio of >1.5 and the log ratio between the signal intensity mean for the pathogen-specific probe set and the mean of a control group probe set is ≥1.5.

EXAMPLES

The following examples are provided to illustrate certain particular features and/or embodiments. These examples should not be construed to limit the disclosure to the particular features or embodiments described.

Example 1

Materials and Methods

Microarray-Based Platform Design

Selection of transfusion-transmitted RNA viruses: Sequences of 16 RNA viruses of concern for transmission to blood recipients (released by AABB Transfusion-Transmitted Diseases Committee (Stramer et al., *Transfusion* 49:1S-29S, 2009)) were downloaded from GenBank at NCBI (available on the World Wide Web at ncbi.nlm.nih.gov/genbank).

The complete genome for each RNA virus was uploaded in FASTA format using Agilent eArray software (available on the World Wide Web at earray.chem.agilent.com/earray/, Agilent Technologies Inc., Santa Clara, CA). Design settings were chosen to select 60-mer sense probes with 3' bias from each viral gene, according to the base composition methodology, which considers fusion temperature, GC % and cross-hybridization potential for probes. To get the best quality level probes for viral genome detection the "best probe" (BP) was selected. The probes were checked for vector and low complexity masking. Entire viral genome sequences were covered to the extent possible with all available Agilent-designed probes. The microarray was supplemented with additional predesigned GE (gene expression) array probes for 906 genes from the human genome (replicated 10 times), ERCC probes (replicated 45 times) and probes covering plant virus sequences (negative control). The selected probes and their characteristics are provided in Table 1.

Oligonucleotide probe selection and methodology: Oligonucleotide probes were synthesized in situ from 3'-end base by base with Agilent SurePrint inkjet technology according to the manufacturer's protocol (Wolber et al., *Meth. Enzymol.* 410:28-57, 2006). The microarrays were manufactured with 60-mer oligonucleotides synthesized in 15,000 features on eight replicate arrays per slide.

Sample collection and processing: Specimens positive for CHIKV, DENV1-4, HIV1-2, WNV strain NY99, and ZIKV were prepared, validated, and supplied by the FDA Center for Biologics Evaluation and Research (CBER) (Dong et al., *J. Appl. Microbiol.* 120:1119-1129, 2016).

HCV genotypes 1a, 2a, and 3, and HEV RNA-positive plasma were purchased from Sera Care (Sera Care, Milford, MA). All positive specimens were diluted in negative plasma (Basematrix diluent, Sera Care) to create a range of concentrations. HAV RNA was obtained from Dr. Patrizia Farci, (National Institutes of Health, Bethesda, MD). HTLV types I and II NATtrol (Nucleic Acid Testing Control) were purchased from ZeptoMetrix (ZeptoMetrix, Buffalo, NY) (Table 2).

TABLE 1

Selected viral probes

| Product | Virus | Target ID | BP Start | SEQ ID NO: | Probe Length |
|---------|-------|-----------|----------|------------|--------------|
| 5 UTR | Hepatitis C genotype 1 | gi\|22129792:1-341 | 243 | 1 | 60 |
| 5 UTR | Hepatitis C genotype 1 | gi\|22129792:1-341 | 194 | 2 | 60 |
| 5 UTR | Hepatitis C genotype 1 | gi\|22129792:1-341 | 193 | 3 | 60 |
| 5 UTR | Hepatitis C genotype 1 | gi\|22129792:1-341 | 173 | 4 | 60 |
| 5 UTR | Hepatitis C genotype 1 | gi\|22129792:1-341 | 172 | 5 | 60 |

TABLE 1-continued

| Selected viral probes | | | | | |
|---|---|---|---|---|---|
| 5 UTR | Hepatitis C genotype 1 | gi\|22129792:1-341 | 171 | 6 | 60 |
| 5 UTR | Hepatitis C genotype 1 | gi\|22129792:1-341 | 170 | 7 | 60 |
| 5 UTR | Hepatitis C genotype 1 | gi\|22129792:1-341 | 169 | 8 | 60 |
| 5 UTR | Hepatitis C genotype 1 | gi\|22129792:1-341 | 168 | 9 | 60 |
| 5 UTR | Hepatitis C genotype 1 | gi\|22129792:1-341 | 167 | 10 | 60 |
| core protein | Hepatitis C genotype 1 | gi\|22129792:342-914 | 488 | 11 | 60 |
| core protein | Hepatitis C genotype 1 | gi\|22129792:342-914 | 487 | 12 | 60 |
| core protein | Hepatitis C genotype 1 | gi\|22129792:342-914 | 486 | 13 | 60 |
| core protein | Hepatitis C genotype 1 | gi\|22129792:342-914 | 485 | 14 | 60 |
| core protein | Hepatitis C genotype 1 | gi\|22129792:342-914 | 484 | 15 | 60 |
| core protein | Hepatitis C genotype 1 | gi\|22129792:342-914 | 483 | 16 | 60 |
| core protein | Hepatitis C genotype 1 | gi\|22129792:342-914 | 482 | 17 | 60 |
| core protein | Hepatitis C genotype 1 | gi\|22129792:342-914 | 481 | 18 | 60 |
| core protein | Hepatitis C genotype 1 | gi\|22129792:342-914 | 480 | 19 | 60 |
| core protein | Hepatitis C genotype 1 | gi\|22129792:342-914 | 479 | 20 | 60 |
| E1 protein | Hepatitis C genotype 1 | gi\|22129792:915-1494 | 342 | 21 | 60 |
| E1 protein | Hepatitis C genotype 1 | gi\|22129792:915-1494 | 341 | 22 | 60 |
| E1 protein | Hepatitis C genotype 1 | gi\|22129792:915-1494 | 340 | 23 | 60 |
| E1 protein | Hepatitis C genotype 1 | gi\|22129792:915-1494 | 339 | 24 | 60 |
| E1 protein | Hepatitis C genotype 1 | gi\|22129792:915-1494 | 504 | 25 | 60 |
| E1 protein | Hepatitis C genotype 1 | gi\|22129792:915-1494 | 503 | 26 | 60 |
| E1 protein | Hepatitis C genotype 1 | gi\|22129792:915-1494 | 502 | 27 | 60 |
| E1 protein | Hepatitis C genotype 1 | gi\|22129792:915-1494 | 501 | 28 | 60 |
| E1 protein | Hepatitis C genotype 1 | gi\|22129792:915-1494 | 500 | 29 | 60 |
| E1 protein | Hepatitis C genotype 1 | gi\|22129792:915-1494 | 379 | 30 | 60 |
| E2 protein | Hepatitis C genotype 1 | gi\|22129792:1491-2579 | 703 | 31 | 60 |
| E2 protein | Hepatitis C genotype 1 | gi\|22129792:1491-2579 | 702 | 32 | 60 |
| E2 protein | Hepatitis C genotype 1 | gi\|22129792:1491-2579 | 701 | 33 | 60 |
| E2 protein | Hepatitis C genotype 1 | gi\|22129792:1491-2579 | 700 | 34 | 60 |
| E2 protein | Hepatitis C genotype 1 | gi\|22129792:1491-2579 | 699 | 35 | 60 |
| E2 protein | Hepatitis C genotype 1 | gi\|22129792:1491-2579 | 697 | 36 | 60 |
| E2 protein | Hepatitis C genotype 1 | gi\|22129792:1491-2579 | 696 | 37 | 60 |
| E2 protein | Hepatitis C genotype 1 | gi\|22129792:1491-2579 | 695 | 38 | 60 |
| E2 protein | Hepatitis C genotype 1 | gi\|22129792:1491-2579 | 694 | 39 | 60 |
| E2 protein | Hepatitis C genotype 1 | gi\|22129792:1491-2579 | 693 | 40 | 60 |
| p7 protein | Hepatitis C genotype 1 | gi\|22129792:2580-2768 | 56 | 41 | 60 |
| p7 protein | Hepatitis C genotype 1 | gi\|22129792:2580-2768 | 55 | 42 | 60 |
| p7 protein | Hepatitis C genotype 1 | gi\|22129792:2580-2768 | 54 | 43 | 60 |
| p7 protein | Hepatitis C genotype 1 | gi\|22129792:2580-2768 | 53 | 44 | 60 |

TABLE 1-continued

| Selected viral probes | | | | | |
|---|---|---|---|---|---|
| p7 protein | Hepatitis C genotype 1 | gi\|22129792:2580-2768 | 52 | 45 | 60 |
| p7 protein | Hepatitis C genotype 1 | gi\|22129792:2580-2768 | 51 | 46 | 60 |
| p7 protein | Hepatitis C genotype 1 | gi\|22129792:2580-2768 | 50 | 47 | 60 |
| p7 protein | Hepatitis C genotype 1 | gi\|22129792:2580-2768 | 49 | 48 | 60 |
| p7 protein | Hepatitis C genotype 1 | gi\|22129792:2580-2768 | 48 | 49 | 60 |
| p7 protein | Hepatitis C genotype 1 | gi\|22129792:2769-3419 | 47 | 50 | 60 |
| NS2 protein | Hepatitis C genotype 1 | gi\|22129792:2580-2768 | 366 | 51 | 60 |
| NS2 protein | Hepatitis C genotype 1 | gi\|22129792:2769-3419 | 194 | 52 | 60 |
| NS2 protein | Hepatitis C genotype 1 | gi\|22129792:2769-3419 | 193 | 53 | 60 |
| NS2 protein | Hepatitis C genotype 1 | gi\|22129792:2769-3419 | 192 | 54 | 60 |
| NS2 protein | Hepatitis C genotype 1 | gi\|22129792:2769-3419 | 191 | 55 | 60 |
| NS2 protein | Hepatitis C genotype 1 | gi\|22129792:2769-3419 | 190 | 56 | 60 |
| NS2 protein | Hepatitis C genotype 1 | gi\|22129792:2769-3419 | 189 | 57 | 60 |
| NS2 protein | Hepatitis C genotype 1 | gi\|22129792:2769-3419 | 188 | 58 | 60 |
| NS2 protein | Hepatitis C genotype 1 | gi\|22129792:2769-3419 | 187 | 59 | 60 |
| NS2 protein | Hepatitis C genotype 1 | gi\|22129792:2769-3419 | 186 | 60 | 60 |
| NS3 protease/helicase | Hepatitis C genotype 1 | gi\|22129792:3420-5312 | 1812 | 61 | 60 |
| NS3 protease/helicase | Hepatitis C genotype 1 | gi\|22129792:3420-5312 | 1620 | 62 | 60 |
| NS3 protease/helicase | Hepatitis C genotype 1 | gi\|22129792:3420-5312 | 849 | 63 | 60 |
| NS3 protease/helicase | Hepatitis C genotype 1 | gi\|22129792:3420-5312 | 1744 | 64 | 60 |
| NS3 protease/helicase | Hepatitis C genotype 1 | gi\|22129792:3420-5312 | 1497 | 65 | 60 |
| NS3 protease/helicase | Hepatitis C genotype 1 | gi\|22129792:3420-5312 | 1294 | 66 | 60 |
| NS3 protease/helicase | Hepatitis C genotype 1 | gi\|22129792:3420-5312 | 1234 | 67 | 60 |
| NS3 protease/helicase | Hepatitis C genotype 1 | gi\|22129792:5313-5474 | 1092 | 68 | 60 |
| NS3 protease/helicase | Hepatitis C genotype 1 | gi\|22129792:3420-5312 | 1020 | 69 | 60 |
| NS3 protease/helicase | Hepatitis C genotype 1 | gi\|22129792:3420-5312 | 765 | 70 | 60 |
| NS4A protein | Hepatitis C genotype 1 | gi\|22129792:3420-5312 | 103 | 71 | 60 |
| NS4A protein | Hepatitis C genotype 1 | gi\|22129792:5313-5474 | 102 | 72 | 60 |
| NS4A protein | Hepatitis C genotype 1 | gi\|22129792:5313-5474 | 101 | 73 | 60 |
| NS4A protein | Hepatitis C genotype 1 | gi\|22129792:5313-5474 | 100 | 74 | 60 |
| NS4A protein | Hepatitis C genotype 1 | gi\|22129792:5313-5474 | 99 | 75 | 60 |
| NS4A protein | Hepatitis C genotype 1 | gi\|22129792:5313-5474 | 98 | 76 | 60 |
| NS4A protein | Hepatitis C genotype 1 | gi\|22129792:5313-5474 | 97 | 77 | 60 |
| NS4A protein | Hepatitis C genotype 1 | gi\|22129792:5313-5474 | 96 | 78 | 60 |
| NS4A protein | Hepatitis C genotype 1 | gi\|22129792:5313-5474 | 95 | 79 | 60 |
| NS4A protein | Hepatitis C genotype 1 | gi\|22129792:5313-5474 | 94 | 80 | 60 |
| NS4B protein | Hepatitis C genotype 1 | gi\|22129792:5475-6257 | 133 | 81 | 60 |
| NS4B protein | Hepatitis C genotype 1 | gi\|22129792:5475-6257 | 723 | 82 | 60 |
| NS4B protein | Hepatitis C genotype 1 | gi\|22129792:5475-6257 | 702 | 83 | 60 |

TABLE 1-continued

| Selected viral probes | | | | | |
|---|---|---|---|---|---|
| NS4B protein | Hepatitis C genotype 1 | gi|22129792:5475-6257 | 456 | 84 | 60 |
| NS4B protein | Hepatitis C genotype 1 | gi|22129792:5475-6257 | 416 | 85 | 60 |
| NS4B protein | Hepatitis C genotype 1 | gi|22129792:5475-6257 | 226 | 86 | 60 |
| NS4B protein | Hepatitis C genotype 1 | gi|22129792:5475-6257 | 204 | 87 | 60 |
| NS4B protein | Hepatitis C genotype 1 | gi|22129792:5475-6257 | 182 | 88 | 60 |
| NS4B protein | Hepatitis C genotype 1 | gi|22129792:5475-6257 | 162 | 89 | 60 |
| NS4B protein | Hepatitis C genotype 1 | gi|22129792:5475-6257 | 113 | 90 | 60 |
| NS5A protein | Hepatitis C genotype 1 | gi|22129792:6258-7601 | 402 | 91 | 60 |
| NS5A protein | Hepatitis C genotype 1 | gi|22129792:6258-7601 | 1138 | 92 | 60 |
| NS5A protein | Hepatitis C genotype 1 | gi|22129792:6258-7601 | 1078 | 93 | 60 |
| NS5A protein | Hepatitis C genotype 1 | gi|22129792:6258-7601 | 974 | 94 | 60 |
| NS5A protein | Hepatitis C genotype 1 | gi|22129792:6258-7601 | 826 | 95 | 60 |
| NS5A protein | Hepatitis C genotype 1 | gi|22129792:6258-7601 | 578 | 96 | 60 |
| NS5A protein | Hepatitis C genotype 1 | gi|22129792:6258-7601 | 515 | 97 | 60 |
| NS5A protein | Hepatitis C genotype 1 | gi|22129792:6258-7601 | 342 | 98 | 60 |
| NS5A protein | Hepatitis C genotype 1 | gi|22129792:6258-7601 | 214 | 99 | 60 |
| NS5A protein | Hepatitis C genotype 1 | gi|22129792:6258-7601 | 154 | 100 | 60 |
| NS5B RNA-dependent RNA polymerase | Hepatitis C genotype 1 | gi|22129792:7602-9374 | 1560 | 101 | 60 |
| NS5B RNA-dependent RNA polymerase | Hepatitis C genotype 1 | gi|22129792:7602-9374 | 1559 | 102 | 60 |
| NS5B RNA-dependent RNA polymerase | Hepatitis C genotype 1 | gi|22129792:7602-9374 | 1558 | 103 | 60 |
| NS5B RNA-dependent RNA polymerase | Hepatitis C genotype 1 | gi|22129792:7602-9374 | 1557 | 104 | 60 |
| NS5B RNA-dependent RNA polymerase | Hepatitis C genotype 1 | gi|22129792:7602-9374 | 1556 | 105 | 60 |
| NS5B RNA-dependent RNA polymerase | Hepatitis C genotype 1 | gi|22129792:7602-9374 | 1391 | 106 | 60 |
| NS5B RNA-dependent RNA polymerase | Hepatitis C genotype 1 | gi|22129792:7602-9374 | 1284 | 107 | 60 |
| NS5B RNA-dependent RNA polymerase | Hepatitis C genotype 1 | gi|22129792:7602-9374 | 1283 | 108 | 60 |
| NS5B RNA-dependent RNA polymerase | Hepatitis C genotype 1 | gi|22129792:7602-9374 | 1232 | 109 | 60 |
| NS5B RNA-dependent RNA polymerase | Hepatitis C genotype 1 | gi|22129792:7602-9374 | 1231 | 110 | 60 |
| 5 UTR | Hepatitis C genotype 2 | gi|157781212:1-321 | 242 | 111 | 60 |
| 5 UTR | Hepatitis C genotype 2 | gi|157781212:1-321 | 172 | 112 | 60 |
| 5 UTR | Hepatitis C genotype 2 | gi|157781212:1-321 | 171 | 113 | 60 |
| 5 UTR | Hepatitis C genotype 2 | gi|157781212:1-321 | 170 | 114 | 60 |
| 5 UTR | Hepatitis C genotype 2 | gi|157781212:1-321 | 169 | 115 | 60 |
| 5 UTR | Hepatitis C genotype 2 | gi|157781212:1-321 | 168 | 116 | 60 |
| 5 UTR | Hepatitis C genotype 2 | gi|157781212:1-321 | 167 | 117 | 60 |

TABLE 1-continued

| Selected viral probes | | | | | |
|---|---|---|---|---|---|
| 5 UTR | Hepatitis C genotype 2 | gi\|157781212:1-321 | 166 | 118 | 60 |
| 5 UTR | Hepatitis C genotype 2 | gi\|157781212:1-321 | 163 | 119 | 60 |
| 5 UTR | Hepatitis C genotype 2 | gi\|157781212:1-321 | 162 | 120 | 60 |
| core protein | Hepatitis C genotype 2 | gi\|157781212:322-906 | 36 | 121 | 60 |
| core protein | Hepatitis C genotype 2 | gi\|157781212:322-906 | 35 | 122 | 60 |
| core protein | Hepatitis C genotype 2 | gi\|157781212:322-906 | 34 | 123 | 60 |
| core protein | Hepatitis C genotype 2 | gi\|157781212:322-906 | 33 | 124 | 60 |
| core protein | Hepatitis C genotype 2 | gi\|157781212:322-906 | 32 | 125 | 60 |
| core protein | Hepatitis C genotype 2 | gi\|157781212:322-906 | 31 | 126 | 60 |
| core protein | Hepatitis C genotype 2 | gi\|157781212:322-906 | 30 | 127 | 60 |
| core protein | Hepatitis C genotype 2 | gi\|157781212:322-906 | 29 | 128 | 60 |
| core protein | Hepatitis C genotype 2 | gi\|157781212:322-906 | 28 | 129 | 60 |
| core protein | Hepatitis C genotype 2 | gi\|157781212:322-906 | 13 | 130 | 60 |
| E1 protein | Hepatitis C genotype 2 | gi\|157781212:921-1498 | 495 | 131 | 60 |
| E1 protein | Hepatitis C genotype 2 | gi\|157781212:921-1498 | 459 | 132 | 60 |
| E1 protein | Hepatitis C genotype 2 | gi\|157781212:921-1498 | 439 | 133 | 60 |
| E1 protein | Hepatitis C genotype 2 | gi\|157781212:921-1498 | 419 | 134 | 60 |
| E1 protein | Hepatitis C genotype 2 | gi\|157781212:921-1498 | 362 | 135 | 60 |
| E1 protein | Hepatitis C genotype 2 | gi\|157781212:921-1498 | 342 | 136 | 60 |
| E1 protein | Hepatitis C genotype 2 | gi\|157781212:921-1498 | 322 | 137 | 60 |
| E1 protein | Hepatitis C genotype 2 | gi\|157781212:921-1498 | 296 | 138 | 60 |
| E1 protein | Hepatitis C genotype 2 | gi\|157781212:921-1498 | 276 | 139 | 60 |
| E1 protein | Hepatitis C genotype 2 | gi\|157781212:1492-2540 | 24 | 140 | 60 |
| E2/NS1 protein | Hepatitis C genotype 2 | gi\|157781212:921-1498 | 944 | 141 | 60 |
| E2/NS1 protein | Hepatitis C genotype 2 | gi\|157781212:1492-2540 | 943 | 142 | 60 |
| E2/NS1 protein | Hepatitis C genotype 2 | gi\|157781212:1492-2540 | 941 | 143 | 60 |
| E2/NS1 protein | Hepatitis C genotype 2 | gi\|157781212:1492-2540 | 940 | 144 | 60 |
| E2/NS1 protein | Hepatitis C genotype 2 | gi\|157781212:1492-2540 | 939 | 145 | 60 |
| E2/NS1 protein | Hepatitis C genotype 2 | gi\|157781212:1492-2540 | 726 | 146 | 60 |
| E2/NS1 protein | Hepatitis C genotype 2 | gi\|157781212:1492-2540 | 725 | 147 | 60 |
| E2/NS1 protein | Hepatitis C genotype 2 | gi\|157781212:1492-2540 | 724 | 148 | 60 |
| E2/NS1 protein | Hepatitis C genotype 2 | gi\|157781212:1492-2540 | 723 | 149 | 60 |
| E2/NS1 protein | Hepatitis C genotype 2 | gi\|157781212:1492-2540 | 722 | 150 | 60 |
| NS2 protein | Hepatitis C genotype 2 | gi\|157781212:2777-3368 | 524 | 151 | 60 |
| NS2 protein | Hepatitis C genotype 2 | gi\|157781212:2777-3368 | 484 | 152 | 60 |
| NS2 protein | Hepatitis C genotype 2 | gi\|157781212:2777-3368 | 409 | 153 | 60 |
| NS2 protein | Hepatitis C genotype 2 | gi\|157781212:2777-3368 | 369 | 154 | 60 |
| NS2 protein | Hepatitis C genotype 2 | gi\|157781212:2777-3368 | 281 | 155 | 60 |
| NS2 protein | Hepatitis C genotype 2 | gi\|157781212:2777-3368 | 239 | 156 | 60 |

TABLE 1-continued

| Selected viral probes | | | | | |
|---|---|---|---|---|---|
| NS2 protein | Hepatitis C genotype 2 | gi\|157781212:2777-3368 | 199 | 157 | 60 |
| NS2 protein | Hepatitis C genotype 2 | gi\|157781212:3512-4759 | 101 | 158 | 60 |
| NS2 protein | Hepatitis C genotype 2 | gi\|157781212:2777-3368 | 61 | 159 | 60 |
| NS2 protein | Hepatitis C genotype 2 | gi\|157781212:2777-3368 | 21 | 160 | 60 |
| NS3 protease/ helicase | Hepatitis C genotype 2 | gi\|157781212:2777-3368 | 992 | 161 | 60 |
| NS3 protease/ helicase | Hepatitis C genotype 2 | gi\|157781212:3512-4759 | 991 | 162 | 60 |
| NS3 protease/ helicase | Hepatitis C genotype 2 | gi\|157781212:3512-4759 | 990 | 163 | 60 |
| NS3 protease/ helicase | Hepatitis C genotype 2 | gi\|157781212:3512-4759 | 989 | 164 | 60 |
| NS3 protease/ helicase | Hepatitis C genotype 2 | gi\|157781212:3512-4759 | 988 | 165 | 60 |
| NS3 protease/ helicase | Hepatitis C genotype 2 | gi\|157781212:3512-4759 | 987 | 166 | 60 |
| NS3 protease/ helicase | Hepatitis C genotype 2 | gi\|157781212:3512-4759 | 986 | 167 | 60 |
| NS3 protease/ helicase | Hepatitis C genotype 2 | gi\|157781212:3512-4759 | 985 | 168 | 60 |
| NS3 protease/ helicase | Hepatitis C genotype 2 | gi\|157781212:3512-4759 | 984 | 169 | 60 |
| NS3 protease/ helicase | Hepatitis C genotype 2 | gi\|157781212:3512-4759 | 983 | 170 | 60 |
| NS4A protein | Hepatitis C genotype 2 | gi\|157781212:5324-5501 | 119 | 171 | 60 |
| NS4A protein | Hepatitis C genotype 2 | gi\|157781212:5324-5501 | 118 | 172 | 60 |
| NS4A protein | Hepatitis C genotype 2 | gi\|157781212:5324-5501 | 117 | 173 | 60 |
| NS4A protein | Hepatitis C genotype 2 | gi\|157781212:5324-5501 | 116 | 174 | 60 |
| NS4A protein | Hepatitis C genotype 2 | gi\|157781212:5324-5501 | 115 | 175 | 60 |
| NS4A protein | Hepatitis C genotype 2 | gi\|157781212:5324-5501 | 114 | 176 | 60 |
| NS4A protein | Hepatitis C genotype 2 | gi\|157781212:5324-5501 | 113 | 177 | 60 |
| NS4A protein | Hepatitis C genotype 2 | gi\|157781212:5324-5501 | 112 | 178 | 60 |
| NS4A protein | Hepatitis C genotype 2 | gi\|157781212:5324-5501 | 111 | 179 | 60 |
| NS4A protein | Hepatitis C genotype 2 | gi\|157781212:5324-5501 | 110 | 180 | 60 |
| NS4B protein | Hepatitis C genotype 2 | gi\|157781212:5531-6115 | 88 | 181 | 60 |
| NS4B protein | Hepatitis C genotype 2 | gi\|157781212:5531-6115 | 87 | 182 | 60 |
| NS4B protein | Hepatitis C genotype 2 | gi\|157781212:5531-6115 | 13 | 183 | 60 |
| NS4B protein | Hepatitis C genotype 2 | gi\|157781212:5531-6115 | 12 | 184 | 60 |
| NS4B protein | Hepatitis C genotype 2 | gi\|157781212:5531-6115 | 8 | 185 | 60 |
| NS4B protein | Hepatitis C genotype 2 | gi\|157781212:5531-6115 | 7 | 186 | 60 |
| NS4B protein | Hepatitis C genotype 2 | gi\|157781212:5531-6115 | 6 | 187 | 60 |
| NS4B protein | Hepatitis C genotype 2 | gi\|157781212:5531-6115 | 5 | 188 | 60 |
| NS4B protein | Hepatitis C genotype 2 | gi\|157781212:5531-6115 | 4 | 189 | 60 |
| NS4B protein | Hepatitis C genotype 2 | gi\|157781212:5531-6115 | 3 | 190 | 60 |
| NS5A protein | Hepatitis C genotype 2 | gi\|157781212:6266-7670 | 54 | 191 | 60 |
| NS5A protein | Hepatitis C genotype 2 | gi\|157781212:6266-7670 | 46 | 192 | 60 |
| NS5A protein | Hepatitis C genotype 2 | gi\|157781212:6266-7670 | 45 | 193 | 60 |
| NS5A protein | Hepatitis C genotype 2 | gi\|157781212:6266-7670 | 43 | 194 | 60 |
| NS5A protein | Hepatitis C genotype 2 | gi\|157781212:6266-7670 | 42 | 195 | 60 |

TABLE 1-continued

| Selected viral probes | | | | | |
|---|---|---|---|---|---|
| NS5A protein | Hepatitis C genotype 2 | gi|157781212:6266-7670 | 41 | 196 | 60 |
| NS5A protein | Hepatitis C genotype 2 | gi|157781212:6266-7670 | 40 | 197 | 60 |
| NS5A protein | Hepatitis C genotype 2 | gi|157781212:6266-7670 | 39 | 198 | 60 |
| NS5A protein | Hepatitis C genotype 2 | gi|157781212:6266-7670 | 38 | 199 | 60 |
| NS5A protein | Hepatitis C genotype 2 | gi|157781212:6266-7670 | 37 | 200 | 60 |
| NS5B RNA-dependent RNA polymerase | Hepatitis C genotype 2 | gi|157781212:7664-9212 | 1389 | 201 | 60 |
| NS5B RNA-dependent RNA polymerase | Hepatitis C genotype 2 | gi|157781212:7664-9212 | 1388 | 202 | 60 |
| NS5B RNA-dependent RNA polymerase | Hepatitis C genotype 2 | gi|157781212:7664-9212 | 1387 | 203 | 60 |
| NS5B RNA-dependent RNA polymerase | Hepatitis C genotype 2 | gi|157781212:7664-9212 | 1386 | 204 | 60 |
| NS5B RNA-dependent RNA polymerase | Hepatitis C genotype 2 | gi|157781212:7664-9212 | 1385 | 205 | 60 |
| NS5B RNA-dependent RNA polymerase | Hepatitis C genotype 2 | gi|157781212:7664-9212 | 1384 | 206 | 60 |
| NS5B RNA-dependent RNA polymerase | Hepatitis C genotype 2 | gi|157781212:7664-9212 | 1383 | 207 | 60 |
| NS5B RNA-dependent RNA polymerase | Hepatitis C genotype 2 | gi|157781212:7664-9212 | 1382 | 208 | 60 |
| NS5B RNA-dependent RNA polymerase | Hepatitis C genotype 2 | gi|157781212:7664-9212 | 1381 | 209 | 60 |
| NS5B RNA-dependent RNA polymerase | Hepatitis C genotype 2 | gi|157781212:7664-9212 | 1380 | 210 | 60 |
| 5 UTR | Hepatitis C genotype 3 | gi|157781216:1-339 | 245 | 211 | 60 |
| 5 UTR | Hepatitis C genotype 3 | gi|157781216:1-339 | 244 | 212 | 60 |
| 5 UTR | Hepatitis C genotype 3 | gi|157781216:1-339 | 242 | 213 | 60 |
| 5 UTR | Hepatitis C genotype 3 | gi|157781216:1-339 | 241 | 214 | 60 |
| 5 UTR | Hepatitis C genotype 3 | gi|157781216:1-339 | 192 | 215 | 60 |
| 5 UTR | Hepatitis C genotype 3 | gi|157781216:1-339 | 191 | 216 | 60 |
| 5 UTR | Hepatitis C genotype 3 | gi|157781216:1-339 | 170 | 217 | 60 |
| 5 UTR | Hepatitis C genotype 3 | gi|157781216:1-339 | 169 | 218 | 60 |
| 5 UTR | Hepatitis C genotype 3 | gi|157781216:1-339 | 168 | 219 | 60 |
| 5 UTR | Hepatitis C genotype 3 | gi|157781216:1-339 | 167 | 220 | 60 |
| Core protein | Hepatitis C genotype 3 | gi|157781216:340-912 | 486 | 221 | 60 |
| Core protein | Hepatitis C genotype 3 | gi|157781216:340-912 | 485 | 222 | 60 |
| Core protein | Hepatitis C genotype 3 | gi|157781216:340-912 | 484 | 223 | 60 |
| Core protein | Hepatitis C genotype 3 | gi|157781216:340-912 | 483 | 224 | 60 |
| Core protein | Hepatitis C genotype 3 | gi|157781216:340-912 | 514 | 225 | 60 |
| Core protein | Hepatitis C genotype 3 | gi|157781216:340-912 | 513 | 226 | 60 |
| Core protein | Hepatitis C genotype 3 | gi|157781216:340-912 | 512 | 227 | 60 |
| Core protein | Hepatitis C genotype 3 | gi|157781216:340-912 | 502 | 228 | 60 |
| Core protein | Hepatitis C genotype 3 | gi|157781216:340-912 | 501 | 229 | 60 |

TABLE 1-continued

| Selected viral probes | | | | | |
|---|---|---|---|---|---|
| Core protein | Hepatitis C genotype 3 | gi\|157781216:913-1488 | 499 | 230 | 60 |
| E1 protein | Hepatitis C genotype 3 | gi\|157781216:340-912 | 37 | 231 | 60 |
| E1 protein | Hepatitis C genotype 3 | gi\|157781216:913-1488 | 36 | 232 | 60 |
| E1 protein | Hepatitis C genotype 3 | gi\|157781216:913-1488 | 35 | 233 | 60 |
| E1 protein | Hepatitis C genotype 3 | gi\|157781216:913-1488 | 34 | 234 | 60 |
| E1 protein | Hepatitis C genotype 3 | gi\|157781216:913-1488 | 33 | 235 | 60 |
| E1 protein | Hepatitis C genotype 3 | gi\|157781216:913-1488 | 32 | 236 | 60 |
| E1 protein | Hepatitis C genotype 3 | gi\|157781216:913-1488 | 31 | 237 | 60 |
| E1 protein | Hepatitis C genotype 3 | gi\|157781216:913-1488 | 30 | 238 | 60 |
| E1 protein | Hepatitis C genotype 3 | gi\|157781216:913-1488 | 29 | 239 | 60 |
| E1 protein | Hepatitis C genotype 3 | gi\|157781216:913-1488 | 28 | 240 | 60 |
| E2/NS1 protein | Hepatitis C genotype 3 | gi\|157781216:1489-2544 | 925 | 241 | 60 |
| E2/NS1 protein | Hepatitis C genotype 3 | gi\|157781216:1489-2544 | 737 | 242 | 60 |
| E2/NS1 protein | Hepatitis C genotype 3 | gi\|157781216:1489-2544 | 736 | 243 | 60 |
| E2/NS1 protein | Hepatitis C genotype 3 | gi\|157781216:1489-2544 | 735 | 244 | 60 |
| E2/NS1 protein | Hepatitis C genotype 3 | gi\|157781216:1489-2544 | 734 | 245 | 60 |
| E2/NS1 protein | Hepatitis C genotype 3 | gi\|157781216:1489-2544 | 733 | 246 | 60 |
| E2/NS1 protein | Hepatitis C genotype 3 | gi\|157781216:1489-2544 | 732 | 247 | 60 |
| E2/NS1 protein | Hepatitis C genotype 3 | gi\|157781216:2545-3375 | 731 | 248 | 60 |
| E2/NS1 protein | Hepatitis C genotype 3 | gi\|157781216:1489-2544 | 730 | 249 | 60 |
| E2/NS1 protein | Hepatitis C genotype 3 | gi\|157781216:1489-2544 | 729 | 250 | 60 |
| NS2 | Hepatitis C genotype 3 | gi\|157781216:1489-2544 | 724 | 251 | 60 |
| NS2 | Hepatitis C genotype 3 | gi\|157781216:2545-3375 | 710 | 252 | 60 |
| NS2 | Hepatitis C genotype 3 | gi\|157781216:2545-3375 | 708 | 253 | 60 |
| NS2 | Hepatitis C genotype 3 | gi\|157781216:2545-3375 | 707 | 254 | 60 |
| NS2 | Hepatitis C genotype 3 | gi\|157781216:2545-3375 | 706 | 255 | 60 |
| NS2 | Hepatitis C genotype 3 | gi\|157781216:2545-3375 | 705 | 256 | 60 |
| NS2 | Hepatitis C genotype 3 | gi\|157781216:2545-3375 | 704 | 257 | 60 |
| NS2 | Hepatitis C genotype 3 | gi\|157781216:2545-3375 | 703 | 258 | 60 |
| NS2 | Hepatitis C genotype 3 | gi\|157781216:2545-3375 | 702 | 259 | 60 |
| NS2 | Hepatitis C genotype 3 | gi\|157781216:2545-3375 | 701 | 260 | 60 |
| NS3 protease/ helicase | Hepatitis C genotype 3 | gi\|157781216:3376-5328 | 1684 | 261 | 60 |
| NS3 protease/ helicase | Hepatitis C genotype 3 | gi\|157781216:3376-5328 | 1682 | 262 | 60 |
| NS3 protease/ helicase | Hepatitis C genotype 3 | gi\|157781216:3376-5328 | 1677 | 263 | 60 |
| NS3 protease/ helicase | Hepatitis C genotype 3 | gi\|157781216:3376-5328 | 1676 | 264 | 60 |
| NS3 protease/ helicase | Hepatitis C genotype 3 | gi\|157781216:3376-5328 | 1674 | 265 | 60 |
| NS3 protease/ helicase | Hepatitis C genotype 3 | gi\|157781216:3376-5328 | 1673 | 266 | 60 |
| NS3 protease/ helicase | Hepatitis C genotype 3 | gi\|157781216:3376-5328 | 1671 | 267 | 60 |
| NS3 protease/ helicase | Hepatitis C genotype 3 | gi\|157781216:3376-5328 | 1645 | 268 | 60 |

TABLE 1-continued

| Selected viral probes | | | | | |
|---|---|---|---|---|---|
| NS3 protease/helicase | Hepatitis C genotype 3 | gi\|157781216:3376-5328 | 1644 | 269 | 60 |
| NS3 protease/helicase | Hepatitis C genotype 3 | gi\|157781216:3376-5328 | 1643 | 270 | 60 |
| NS4A protein | Hepatitis C genotype 3 | gi\|157781216:5329-5490 | 103 | 271 | 60 |
| NS4A protein | Hepatitis C genotype 3 | gi\|157781216:5329-5490 | 102 | 272 | 60 |
| NS4A protein | Hepatitis C genotype 3 | gi\|157781216:5329-5490 | 101 | 273 | 60 |
| NS4A protein | Hepatitis C genotype 3 | gi\|157781216:5329-5490 | 100 | 274 | 60 |
| NS4A protein | Hepatitis C genotype 3 | gi\|157781216:5329-5490 | 99 | 275 | 60 |
| NS4A protein | Hepatitis C genotype 3 | gi\|157781216:5329-5490 | 98 | 276 | 60 |
| NS4A protein | Hepatitis C genotype 3 | gi\|157781216:5329-5490 | 97 | 277 | 60 |
| NS4A protein | Hepatitis C genotype 3 | gi\|157781216:5329-5490 | 96 | 278 | 60 |
| NS4A protein | Hepatitis C genotype 3 | gi\|157781216:5329-5490 | 95 | 279 | 60 |
| NS4A protein | Hepatitis C genotype 3 | gi\|157781216:5329-5490 | 94 | 280 | 60 |
| NS4B protein | Hepatitis C genotype 3 | gi\|157781216:5491-6273 | 237 | 281 | 60 |
| NS4B protein | Hepatitis C genotype 3 | gi\|157781216:5491-6273 | 236 | 282 | 60 |
| NS4B protein | Hepatitis C genotype 3 | gi\|157781216:5491-6273 | 133 | 283 | 60 |
| NS4B protein | Hepatitis C genotype 3 | gi\|157781216:5491-6273 | 132 | 284 | 60 |
| NS4B protein | Hepatitis C genotype 3 | gi\|157781216:5491-6273 | 130 | 285 | 60 |
| NS4B protein | Hepatitis C genotype 3 | gi\|157781216:5491-6273 | 129 | 286 | 60 |
| NS4B protein | Hepatitis C genotype 3 | gi\|157781216:5491-6273 | 118 | 287 | 60 |
| NS4B protein | Hepatitis C genotype 3 | gi\|157781216:5491-6273 | 117 | 288 | 60 |
| NS4B protein | Hepatitis C genotype 3 | gi\|157781216:5491-6273 | 116 | 289 | 60 |
| NS4B protein | Hepatitis C genotype 3 | gi\|157781216:5491-6273 | 115 | 290 | 60 |
| NS5A protein | Hepatitis C genotype 3 | gi\|157781216:6274-7629 | 513 | 291 | 60 |
| NS5A protein | Hepatitis C genotype 3 | gi\|157781216:6274-7629 | 512 | 292 | 60 |
| NS5A protein | Hepatitis C genotype 3 | gi\|157781216:6274-7629 | 511 | 293 | 60 |
| NS5A protein | Hepatitis C genotype 3 | gi\|157781216:6274-7629 | 510 | 294 | 60 |
| NS5A protein | Hepatitis C genotype 3 | gi\|157781216:6274-7629 | 509 | 295 | 60 |
| NS5A protein | Hepatitis C genotype 3 | gi\|157781216:6274-7629 | 508 | 296 | 60 |
| NS5A protein | Hepatitis C genotype 3 | gi\|157781216:6274-7629 | 507 | 297 | 60 |
| NS5A protein | Hepatitis C genotype 3 | gi\|157781216:6274-7629 | 506 | 298 | 60 |
| NS5A protein | Hepatitis C genotype 3 | gi\|157781216:6274-7629 | 505 | 299 | 60 |
| NS5A protein | Hepatitis C genotype 3 | gi\|157781216:6274-7629 | 504 | 300 | 60 |
| NS5B RNA-dependent RNA polymerase | Hepatitis C genotype 3 | gi\|157781216:7630-9402 | 1548 | 301 | 60 |
| NS5B RNA-dependent RNA polymerase | Hepatitis C genotype 3 | gi\|157781216:7630-9402 | 1373 | 302 | 60 |
| NS5B RNA-dependent RNA polymerase | Hepatitis C genotype 3 | gi\|157781216:7630-9402 | 1350 | 303 | 60 |
| NS5B RNA-dependent RNA polymerase | Hepatitis C genotype 3 | gi\|157781216:7630-9402 | 1330 | 304 | 60 |

TABLE 1-continued

| Selected viral probes | | | | | |
|---|---|---|---|---|---|
| NS5B RNA-dependent RNA polymerase | Hepatitis C genotype 3 | gi\|157781216:7630-9402 | 1283 | 305 | 60 |
| NS5B RNA-dependent RNA polymerase | Hepatitis C genotype 3 | gi\|157781216:7630-9402 | 1262 | 306 | 60 |
| NS5B RNA-dependent RNA polymerase | Hepatitis C genotype 3 | gi\|157781216:7630-9402 | 672 | 307 | 60 |
| NS5B RNA-dependent RNA polymerase | Hepatitis C genotype 3 | gi\|157781216:7630-9402 | 526 | 308 | 60 |
| NS5B RNA-dependent RNA polymerase | Hepatitis C genotype 3 | gi\|157781216:7630-9402 | 147 | 309 | 60 |
| NS5B RNA-dependent RNA polymerase | Hepatitis C genotype 3 | gi\|157781216:7630-9402 | 99 | 310 | 60 |
| Gag-Pol | HIV 1 | gi\|9629357:336-4642 | 4241 | 311 | 60 |
| Gag-Pol | HIV 1 | gi\|9629357:336-4642 | 4164 | 312 | 60 |
| Gag-Pol | HIV 1 | gi\|9629357:336-4642 | 4104 | 313 | 60 |
| Gag-Pol | HIV 1 | gi\|9629357:336-4642 | 4013 | 314 | 60 |
| Gag-Pol | HIV 1 | gi\|9629357:336-4642 | 3953 | 315 | 60 |
| Gag-Pol | HIV 1 | gi\|9629357:336-4642 | 3858 | 316 | 60 |
| Gag-Pol | HIV 1 | gi\|9629357:336-4642 | 3762 | 317 | 60 |
| Gag-Pol | HIV 1 | gi\|9629357:336-4642 | 3702 | 318 | 60 |
| Gag-Pol | HIV 1 | gi\|9629357:336-4642 | 3642 | 319 | 60 |
| Gag-Pol | HIV 1 | gi\|9629357:336-1838 | 3582 | 320 | 60 |
| gag | HIV 1 | gi\|9629357:336-4642 | 1295 | 321 | 60 |
| gag | HIV 1 | gi\|9629357:336-1838 | 1235 | 322 | 60 |
| gag | HIV 1 | gi\|9629357:336-1838 | 1162 | 323 | 60 |
| gag | HIV 1 | gi\|9629357:336-1838 | 1102 | 324 | 60 |
| gag | HIV 1 | gi\|9629357:336-1838 | 959 | 325 | 60 |
| gag | HIV 1 | gi\|9629357:336-1838 | 899 | 326 | 60 |
| gag | HIV 1 | gi\|9629357:336-1838 | 837 | 327 | 60 |
| gag | HIV 1 | gi\|9629357:336-1838 | 750 | 328 | 60 |
| gag | HIV 1 | gi\|9629357:336-1838 | 690 | 329 | 60 |
| gag | HIV 1 | gi\|9629357:336-1838 | 601 | 330 | 60 |
| Vif | HIV 1 | gi\|9629357:4587-5165 | 466 | 331 | 60 |
| Vif | HIV 1 | gi\|9629357:4587-5165 | 426 | 332 | 60 |
| Vif | HIV 1 | gi\|9629357:4587-5165 | 386 | 333 | 60 |
| Vif | HIV 1 | gi\|9629357:4587-5165 | 346 | 334 | 60 |
| Vif | HIV 1 | gi\|9629357:4587-5165 | 304 | 335 | 60 |
| Vif | HIV 1 | gi\|9629357:4587-5165 | 264 | 336 | 60 |
| Vif | HIV 1 | gi\|9629357:4587-5165 | 224 | 337 | 60 |
| Vif | HIV 1 | gi\|9629357:5105-5396 | 184 | 338 | 60 |
| Vif | HIV 1 | gi\|9629357:4587-5165 | 144 | 339 | 60 |
| Vif | HIV 1 | gi\|9629357:4587-5165 | 104 | 340 | 60 |
| vpr | HIV 1 | gi\|9629357:4587-5165 | 215 | 341 | 60 |
| vpr | HIV 1 | gi\|9629357:5105-5396 | 195 | 342 | 60 |
| vpr | HIV 1 | gi\|9629357:5105-5396 | 175 | 343 | 60 |
| vpr | HIV 1 | gi\|9629357:5105-5396 | 155 | 344 | 60 |
| vpr | HIV 1 | gi\|9629357:5105-5396 | 135 | 345 | 60 |
| vpr | HIV 1 | gi\|9629357:5105-5396 | 109 | 346 | 60 |
| vpr | HIV 1 | gi\|9629357:5105-5396 | 89 | 347 | 60 |
| vpr | HIV 1 | gi\|9629357:5105-5396 | 69 | 348 | 60 |
| vpr | HIV 1 | gi\|9629357:5105-5396 | 49 | 349 | 60 |
| vpr | HIV 1 | gi\|9629357:5105-5396 | 29 | 350 | 60 |
| tat | HIV 1 | gi\|9629357:5377-7970 | 2504 | 351 | 60 |
| tat | HIV 1 | gi\|9629357:5377-7970 | 2377 | 352 | 60 |
| tat | HIV 1 | gi\|9629357:5377-7970 | 2310 | 353 | 60 |
| tat | HIV 1 | gi\|9629357:5377-7970 | 2250 | 354 | 60 |
| tat | HIV 1 | gi\|9629357:5377-7970 | 2190 | 355 | 60 |
| tat | HIV 1 | gi\|9629357:5377-7970 | 2023 | 356 | 60 |
| tat | HIV 1 | gi\|9629357:5377-7970 | 1903 | 357 | 60 |
| tat | HIV 1 | gi\|9629357:5377-7970 | 1771 | 358 | 60 |
| tat | HIV 1 | gi\|9629357:5377-7970 | 1711 | 359 | 60 |
| tat | HIV 1 | gi\|9629357:5377-7970 | 1651 | 360 | 60 |
| rev | HIV 1 | gi\|9629357:5516-8199 | 2625 | 361 | 60 |
| rev | HIV 1 | gi\|9629357:5516-8199 | 2551 | 362 | 60 |
| rev | HIV 1 | gi\|9629357:5516-8199 | 2454 | 363 | 60 |
| rev | HIV 1 | gi\|9629357:5516-8199 | 2365 | 364 | 60 |
| rev | HIV 1 | gi\|9629357:5516-8199 | 2238 | 365 | 60 |
| rev | HIV 1 | gi\|9629357:5516-8199 | 2171 | 366 | 60 |
| rev | HIV 1 | gi\|9629357:5516-8199 | 2111 | 367 | 60 |
| rev | HIV 1 | gi\|9629357:5516-8199 | 2051 | 368 | 60 |
| rev | HIV 1 | gi\|9629357:5516-8199 | 1884 | 369 | 60 |
| rev | HIV 1 | gi\|9629357:5516-8199 | 1764 | 370 | 60 |

TABLE 1-continued

| Selected viral probes | | | | | |
|---|---|---|---|---|---|
| vpu | HIV 1 | gi\|9629357:5608-5856 | 136 | 371 | 60 |
| vpu | HIV 1 | gi\|9629357:5608-5856 | 189 | 372 | 60 |
| vpu | HIV 1 | gi\|9629357:5608-5856 | 188 | 373 | 60 |
| vpu | HIV 1 | gi\|9629357:5608-5856 | 186 | 374 | 60 |
| vpu | HIV 1 | gi\|9629357:5608-5856 | 184 | 375 | 60 |
| vpu | HIV 1 | gi\|9629357:5608-5856 | 183 | 376 | 60 |
| vpu | HIV 1 | gi\|9629357:5608-5856 | 182 | 377 | 60 |
| vpu | HIV 1 | gi\|9629357:5608-5856 | 181 | 378 | 60 |
| vpu | HIV 1 | gi\|9629357:5608-5856 | 180 | 379 | 60 |
| vpu | HIV 1 | gi\|9629357:5608-5856 | 179 | 380 | 60 |
| asp | HIV 1 | gi\|9629357:6919-7488 | 478 | 381 | 60 |
| asp | HIV 1 | gi\|9629357:6919-7488 | 361 | 382 | 60 |
| asp | HIV 1 | gi\|9629357:6919-7488 | 315 | 383 | 60 |
| asp | HIV 1 | gi\|9629357:6919-7488 | 212 | 384 | 60 |
| asp | HIV 1 | gi\|9629357:6919-7488 | 182 | 385 | 60 |
| asp | HIV 1 | gi\|9629357:6919-7488 | 152 | 386 | 60 |
| asp | HIV 1 | gi\|9629357:6919-7488 | 122 | 387 | 60 |
| asp | HIV 1 | gi\|9629357:6919-7488 | 92 | 388 | 60 |
| asp | HIV 1 | gi\|9629357:6919-7488 | 62 | 389 | 60 |
| asp | HIV 1 | gi\|9629357:6919-7488 | 32 | 390 | 60 |
| nef | HIV 1 | gi\|9629357:8343-8963 | 443 | 391 | 60 |
| nef | HIV 1 | gi\|9629357:8343-8963 | 423 | 392 | 60 |
| nef | HIV 1 | gi\|9629357:8343-8963 | 402 | 393 | 60 |
| nef | HIV 1 | gi\|9629357:8343-8963 | 322 | 394 | 60 |
| nef | HIV 1 | gi\|9629357:8343-8963 | 302 | 395 | 60 |
| nef | HIV 1 | gi\|9629357:8343-8963 | 274 | 396 | 60 |
| nef | HIV 1 | gi\|9629357:8343-8963 | 254 | 397 | 60 |
| nef | HIV 1 | gi\|9629357:8343-8963 | 234 | 398 | 60 |
| nef | HIV 1 | gi\|9629357:8343-8963 | 214 | 399 | 60 |
| nef | HIV 1 | gi\|9629357:8343-8963 | 105 | 400 | 60 |
| 5' LTR | HIV 2 | gi\|9628880:1-855 | 701 | 401 | 60 |
| 5' LTR | HIV 2 | gi\|9628880:1-855 | 513 | 402 | 60 |
| 5' LTR | HIV 2 | gi\|9628880:1-855 | 384 | 403 | 60 |
| 5' LTR | HIV 2 | gi\|9628880:1-855 | 354 | 404 | 60 |
| 5' LTR | HIV 2 | gi\|9628880:1-855 | 324 | 405 | 60 |
| 5' LTR | HIV 2 | gi\|9628880:1-855 | 209 | 406 | 60 |
| 5' LTR | HIV 2 | gi\|9628880:1-855 | 141 | 407 | 60 |
| 5' LTR | HIV 2 | gi\|9628880:1-855 | 68 | 408 | 60 |
| 5' LTR | HIV 2 | gi\|9628880:1-855 | 38 | 409 | 60 |
| 5' LTR | HIV 2 | gi\|9628880:1-855 | 8 | 410 | 60 |
| gag polyprotein | HIV 2 | gi\|9628880:1103-2668 | 1137 | 411 | 60 |
| gag polyprotein | HIV 2 | gi\|9628880:1103-2668 | 990 | 412 | 60 |
| gag polyprotein | HIV 2 | gi\|9628880:1103-2668 | 930 | 413 | 60 |
| gag polyprotein | HIV 2 | gi\|9628880:1103-2668 | 870 | 414 | 60 |
| gag polyprotein | HIV 2 | gi\|9628880:1103-2668 | 810 | 415 | 60 |
| gag polyprotein | HIV 2 | gi\|9628880:1103-2668 | 750 | 416 | 60 |
| gag polyprotein | HIV 2 | gi\|9628880:1103-2668 | 606 | 417 | 60 |
| gag polyprotein | HIV 2 | gi\|9628880:1103-2668 | 546 | 418 | 60 |
| gag polyprotein | HIV 2 | gi\|9628880:1103-2668 | 473 | 419 | 60 |
| gag polyprotein | HIV 2 | gi\|9628880:1103-2668 | 348 | 420 | 60 |
| gag-pol | HIV 2 | gi\|9628880:1103-5754 | 4593 | 421 | 60 |
| gag-pol | HIV 2 | gi\|9628880:1103-5754 | 4533 | 422 | 60 |
| gag-pol | HIV 2 | gi\|9628880:1103-5754 | 4473 | 423 | 60 |
| gag-pol | HIV 2 | gi\|9628880:1103-5754 | 4388 | 424 | 60 |
| gag-pol | HIV 2 | gi\|9628880:1103-5754 | 4273 | 425 | 60 |
| gag-pol | HIV 2 | gi\|9628880:1103-5754 | 4173 | 426 | 60 |
| gag-pol | HIV 2 | gi\|9628880:1103-5754 | 4096 | 427 | 60 |
| gag-pol | HIV 2 | gi\|9628880:1103-5754 | 4036 | 428 | 60 |
| gag-pol | HIV 2 | gi\|9628880:1103-5754 | 3950 | 429 | 60 |
| gag-pol | HIV 2 | gi\|9628880:1103-5754 | 3889 | 430 | 60 |
| gp2-vif protein | HIV 2 | gi\|9628880:5423-6070 | 440 | 431 | 60 |
| gp2-vif protein | HIV 2 | gi\|9628880:5423-6070 | 388 | 432 | 60 |
| gp2-vif protein | HIV 2 | gi\|9628880:5423-6070 | 338 | 433 | 60 |
| gp2-vif protein | HIV 2 | gi\|9628880:5423-6070 | 308 | 434 | 60 |

TABLE 1-continued

| Selected viral probes | | | | | |
|---|---|---|---|---|---|
| gp2-vif protein | HIV 2 | gi\|9628880:5423-6070 | 277 | 435 | 60 |
| gp2-vif protein | HIV 2 | gi\|9628880:5423-6070 | 247 | 436 | 60 |
| gp2-vif protein | HIV 2 | gi\|9628880:5423-6070 | 217 | 437 | 60 |
| gp2-vif protein | HIV 2 | gi\|9628880:5423-6070 | 185 | 438 | 60 |
| gp2-vif protein | HIV 2 | gi\|9628880:5423-6070 | 155 | 439 | 60 |
| gp2-vif protein | HIV 2 | gi\|9628880:5423-6070 | 58 | 440 | 60 |
| gp3-vpx Protein | HIV 2 | gi\|9628880:5898-6239 | 223 | 441 | 60 |
| gp3-vpx Protein | HIV 2 | gi\|9628880:5898-6239 | 222 | 442 | 60 |
| gp3-vpx Protein | HIV 2 | gi\|9628880:5898-6239 | 221 | 443 | 60 |
| gp3-vpx Protein | HIV 2 | gi\|9628880:5898-6239 | 220 | 444 | 60 |
| gp3-vpx Protein | HIV 2 | gi\|9628880:5898-6239 | 219 | 445 | 60 |
| gp3-vpx Protein | HIV 2 | gi\|9628880:5898-6239 | 217 | 446 | 60 |
| gp3-vpx Protein | HIV 2 | gi\|9628880:5898-6239 | 216 | 447 | 60 |
| gp3-vpx Protein | HIV 2 | gi\|9628880:5898-6239 | 215 | 448 | 60 |
| gp3-vpx Protein | HIV 2 | gi\|9628880:5898-6239 | 214 | 449 | 60 |
| gp3-vpx Protein | HIV 2 | gi\|9628880:5898-6239 | 213 | 450 | 60 |
| gp4-vpr protein | HIV 2 | gi\|9628880:6239-6502 | 151 | 451 | 60 |
| gp4-vpr protein | HIV 2 | gi\|9628880:6239-6502 | 150 | 452 | 60 |
| gp4-vpr protein | HIV 2 | gi\|9628880:6239-6502 | 149 | 453 | 60 |
| gp4-vpr protein | HIV 2 | gi\|9628880:6239-6502 | 148 | 454 | 60 |
| gp4-vpr protein | HIV 2 | gi\|9628880:6239-6502 | 147 | 455 | 60 |
| gp4-vpr protein | HIV 2 | gi\|9628880:6239-6502 | 146 | 456 | 60 |
| gp4-vpr protein | HIV 2 | gi\|9628880:6239-6502 | 145 | 457 | 60 |
| gp4-vpr protein | HIV 2 | gi\|9628880:6239-6502 | 144 | 458 | 60 |
| gp4-vpr protein | HIV 2 | gi\|9628880:6239-6502 | 143 | 459 | 60 |
| gp4-vpr protein | HIV 2 | gi\|9628880:6239-6502 | 142 | 460 | 60 |
| gp5-tat protein | HIV 2 | gi\|9628880:6402-8957 | 2383 | 461 | 60 |
| gp5-tat protein | HIV 2 | gi\|9628880:6402-8957 | 2314 | 462 | 60 |
| gp5-tat protein | HIV 2 | gi\|9628880:6402-8957 | 2192 | 463 | 60 |
| gp5-tat protein | HIV 2 | gi\|9628880:6402-8957 | 2131 | 464 | 60 |
| gp5-tat protein | HIV 2 | gi\|9628880:6402-8957 | 2047 | 465 | 60 |
| gp5-tat protein | HIV 2 | gi\|9628880:6402-8957 | 1938 | 466 | 60 |
| gp5-tat protein | HIV 2 | gi\|9628880:6402-8957 | 1762 | 467 | 60 |
| gp5-tat protein | HIV 2 | gi\|9628880:6402-8957 | 1702 | 468 | 60 |
| gp5-tat protein | HIV 2 | gi\|9628880:6402-8957 | 1579 | 469 | 60 |
| gp5-tat protein | HIV 2 | gi\|9628880:6402-8957 | 1519 | 470 | 60 |
| gp6-rev protein | HIV 2 | gi\|9628880:6628-9102 | 2355 | 471 | 60 |
| gp6-rev protein | HIV 2 | gi\|9628880:6628-9102 | 2157 | 472 | 60 |
| gp6-rev protein | HIV 2 | gi\|9628880:6628-9102 | 2088 | 473 | 60 |

TABLE 1-continued

Selected viral probes

| | | | | | |
|---|---|---|---|---|---|
| gp6-rev protein | HIV 2 | gi\|9628880:6628-9102 | 1966 | 474 | 60 |
| gp6-rev protein | HIV 2 | gi\|9628880:6628-9102 | 1905 | 475 | 60 |
| gp6-rev protein | HIV 2 | gi\|9628880:6628-9102 | 1821 | 476 | 60 |
| gp6-rev protein | HIV 2 | gi\|9628880:6628-9102 | 1712 | 477 | 60 |
| gp6-rev protein | HIV 2 | gi\|9628880:6628-9102 | 1536 | 478 | 60 |
| gp6-rev protein | HIV 2 | gi\|9628880:6628-9102 | 1476 | 479 | 60 |
| gp6-rev protein | HIV 2 | gi\|9628880:6628-9102 | 1353 | 480 | 60 |
| gp7-env protein | HIV 2 | gi\|9628880:6704-9286 | 2279 | 481 | 60 |
| gp7-env protein | HIV 2 | gi\|9628880:6704-9286 | 2081 | 482 | 60 |
| gp7-env protein | HIV 2 | gi\|9628880:6704-9286 | 2012 | 483 | 60 |
| gp7-env protein | HIV 2 | gi\|9628880:6704-9286 | 1890 | 484 | 60 |
| gp7-env protein | HIV 2 | gi\|9628880:6704-9286 | 1829 | 485 | 60 |
| gp7-env protein | HIV 2 | gi\|9628880:6704-9286 | 1745 | 486 | 60 |
| gp7-env protein | HIV 2 | gi\|9628880:6704-9286 | 1636 | 487 | 60 |
| gp7-env protein | HIV 2 | gi\|9628880:6704-9286 | 1460 | 488 | 60 |
| gp7-env protein | HIV 2 | gi\|9628880:6704-9286 | 1400 | 489 | 60 |
| gp7-env protein | HIV 2 | gi\|9628880:6704-9286 | 1277 | 490 | 60 |
| gp8-nef protein | HIV 2 | gi\|9628880:9120-9893 | 709 | 491 | 60 |
| gp8-nef protein | HIV 2 | gi\|9628880:9120-9893 | 594 | 492 | 60 |
| gp8-nef protein | HIV 2 | gi\|9628880:9120-9893 | 526 | 493 | 60 |
| gp8-nef protein | HIV 2 | gi\|9628880:9120-9893 | 453 | 494 | 60 |
| gp8-nef protein | HIV 2 | gi\|9628880:9120-9893 | 423 | 495 | 60 |
| gp8-nef protein | HIV 2 | gi\|9628880:9120-9893 | 393 | 496 | 60 |
| gp8-nef protein | HIV 2 | gi\|9628880:9120-9893 | 359 | 497 | 60 |
| gp8-nef protein | HIV 2 | gi\|9628880:9120-9893 | 308 | 498 | 60 |
| gp8-nef protein | HIV 2 | gi\|9628880:9120-9893 | 278 | 499 | 60 |
| gp8-nef protein | HIV 2 | gi\|9628880:9120-9893 | 248 | 500 | 60 |
| 3 LTR | HIV 2 | | 701 | 501 | 60 |
| 3 LTR | HIV 2 | | 513 | 502 | 60 |
| 3 LTR | HIV 2 | | 384 | 503 | 60 |
| 3 LTR | HIV 2 | | 354 | 504 | 60 |
| 3 LTR | HIV 2 | | 324 | 505 | 60 |
| 3 LTR | HIV 2 | | 209 | 506 | 60 |
| 3 LTR | HIV 2 | | 141 | 507 | 60 |
| 3 LTR | HIV 2 | | 68 | 508 | 60 |
| 3 LTR | HIV 2 | | 38 | 509 | 60 |
| 3 LTR | HIV 2 | | 8 | 510 | 60 |
| gag | HTLV 1 | gb\|AF033817.1\|:450-1739 | 927 | 511 | 60 |
| gag | HTLV 1 | gb\|AF033817.1\|:450-1739 | 926 | 512 | 60 |
| gag | HTLV 1 | gb\|AF033817.1\|:450-1739 | 925 | 513 | 60 |
| gag | HTLV 1 | gb\|AF033817.1\|:450-1739 | 924 | 514 | 60 |
| gag | HTLV 1 | gb\|AF033817.1\|:450-1739 | 923 | 515 | 60 |
| gag | HTLV 1 | gb\|AF033817.1\|:450-1739 | 922 | 516 | 60 |
| gag | HTLV 1 | gb\|AF033817.1\|:450-1739 | 921 | 517 | 60 |
| gag | HTLV 1 | gb\|AF033817.1\|:450-1739 | 917 | 518 | 60 |
| gag | HTLV 1 | gb\|AF033817.1\|:450-1739 | 916 | 519 | 60 |
| gag | HTLV 1 | gb\|AF033817.1\|:450-1739 | 915 | 520 | 60 |
| pro | HTLV 1 | gb\|AF033817.1\|:1718-2404 | 609 | 521 | 60 |
| pro | HTLV 1 | gb\|AF033817.1\|:1718-2404 | 608 | 522 | 60 |
| pro | HTLV 1 | gb\|AF033817.1\|:1718-2404 | 607 | 523 | 60 |
| pro | HTLV 1 | gb\|AF033817.1\|:1718-2404 | 606 | 524 | 60 |

TABLE 1-continued

| | | Selected viral probes | | | |
|---|---|---|---|---|---|
| pro | HTLV 1 | gb|AF033817.1|:1718-2404 | 605 | 525 | 60 |
| pro | HTLV 1 | gb|AF033817.1|:1718-2404 | 604 | 526 | 60 |
| pro | HTLV 1 | gb|AF033817.1|:1718-2404 | 603 | 527 | 60 |
| pro | HTLV 1 | gb|AF033817.1|:1718-2404 | 602 | 528 | 60 |
| pro | HTLV 1 | gb|AF033817.1|:1718-2404 | 583 | 529 | 60 |
| pro | HTLV 1 | gb|AF033817.1|:1718-2404 | 582 | 530 | 60 |
| Pol | HTLV 1 | gi|9626453:2245-4836 | 2376 | 531 | 60 |
| Pol | HTLV 1 | gi|9626453:2245-4836 | 2262 | 532 | 60 |
| Pol | HTLV 1 | gi|9626453:2245-4836 | 2202 | 533 | 60 |
| Pol | HTLV 1 | gi|9626453:2245-4836 | 2051 | 534 | 60 |
| Pol | HTLV 1 | gi|9626453:2245-4836 | 1984 | 535 | 60 |
| Pol | HTLV 1 | gi|9626453:2245-4836 | 1914 | 536 | 60 |
| Pol | HTLV 1 | gi|9626453:2245-4836 | 1475 | 537 | 60 |
| Pol | HTLV 1 | gi|9626453:2245-4836 | 1333 | 538 | 60 |
| Pol | HTLV 1 | gi|9626453:2245-4836 | 1242 | 539 | 60 |
| Pol | HTLV 1 | gi|9626453:2245-4836 | 1182 | 540 | 60 |
| rex | HTLV 1 | gi|9626453:4773-8008 | 3128 | 541 | 60 |
| rex | HTLV 1 | gi|9626453:4773-8008 | 3068 | 542 | 60 |
| rex | HTLV 1 | gi|9626453:4773-8008 | 2975 | 543 | 60 |
| rex | HTLV 1 | gi|9626453:4773-8008 | 2758 | 544 | 60 |
| rex | HTLV 1 | gi|9626453:4773-8008 | 2160 | 545 | 60 |
| rex | HTLV 1 | gi|9626453:4773-8008 | 1489 | 546 | 60 |
| rex | HTLV 1 | gi|9626453:4773-8008 | 1251 | 547 | 60 |
| rex | HTLV 1 | gi|9626453:4773-8008 | 1146 | 548 | 60 |
| rex | HTLV 1 | gi|9626453:4773-8008 | 1086 | 549 | 60 |
| rex | HTLV 1 | gi|9626453:4773-8008 | 721 | 550 | 60 |
| tax | HTLV 1 | gi|9626453:4829-8008 | 3072 | 551 | 60 |
| tax | HTLV 1 | gi|9626453:4829-8008 | 3012 | 552 | 60 |
| tax | HTLV 1 | gi|9626453:4829-8008 | 2919 | 553 | 60 |
| tax | HTLV 1 | gi|9626453:4829-8008 | 2702 | 554 | 60 |
| tax | HTLV 1 | gi|9626453:4829-8008 | 2104 | 555 | 60 |
| tax | HTLV 1 | gi|9626453:4829-8008 | 1433 | 556 | 60 |
| tax | HTLV 1 | gi|9626453:4829-8008 | 1195 | 557 | 60 |
| tax | HTLV 1 | gi|9626453:4829-8008 | 1090 | 558 | 60 |
| tax | HTLV 1 | gi|9626453:4829-8008 | 1030 | 559 | 60 |
| tax | HTLV 1 | gi|9626453:4829-8008 | 665 | 560 | 60 |
| env | HTLV 1 | gi|9626453:4829-6295 | 1192 | 561 | 60 |
| env | HTLV 1 | gi|9626453:4829-6295 | 1152 | 562 | 60 |
| env | HTLV 1 | gi|9626453:4829-6295 | 1085 | 563 | 60 |
| env | HTLV 1 | gi|9626453:4829-6295 | 1045 | 564 | 60 |
| env | HTLV 1 | gi|9626453:4829-6295 | 662 | 565 | 60 |
| env | HTLV 1 | gi|9626453:4829-6295 | 621 | 566 | 60 |
| env | HTLV 1 | gi|9626453:4829-6295 | 454 | 567 | 60 |
| env | HTLV 1 | gi|9626453:4829-6295 | 388 | 568 | 60 |
| env | HTLV 1 | gi|9626453:4829-6295 | 297 | 569 | 60 |
| env | HTLV 1 | gi|9626453:4829-6295 | 257 | 570 | 60 |
| 5' LTR | HTLV 2 | gi|9626726:1-763 | 262 | 571 | 60 |
| 5' LTR | HTLV 2 | gi|9626726:1-763 | 261 | 572 | 60 |
| 5' LTR | HTLV 2 | gi|9626726:1-763 | 260 | 573 | 60 |
| 5' LTR | HTLV 2 | gi|9626726:1-763 | 258 | 574 | 60 |
| 5' LTR | HTLV 2 | gi|9626726:1-763 | 257 | 575 | 60 |
| 5' LTR | HTLV 2 | gi|9626726:1-763 | 256 | 576 | 60 |
| 5' LTR | HTLV 2 | gi|9626726:1-763 | 255 | 577 | 60 |
| 5' LTR | HTLV 2 | gi|9626726:1-763 | 254 | 578 | 60 |
| 5' LTR | HTLV 2 | gi|9626726:1-763 | 253 | 579 | 60 |
| 5' LTR | HTLV 2 | gi|9626726:1-763 | 251 | 580 | 60 |
| gp1-tax protein | HTLV 2 | gi|9626726:6-119 | 52 | 581 | 60 |
| gp1-tax protein | HTLV 2 | gi|9626726:6-119 | 51 | 582 | 60 |
| gp1-tax protein | HTLV 2 | gi|9626726:6-119 | 50 | 583 | 60 |
| gp1-tax protein | HTLV 2 | gi|9626726:6-119 | 48 | 584 | 60 |
| gp1-tax protein | HTLV 2 | gi|9626726:6-119 | 44 | 585 | 60 |
| gp1-tax protein | HTLV 2 | gi|9626726:6-119 | 43 | 586 | 60 |
| gp1-tax protein | HTLV 2 | gi|9626726:6-119 | 42 | 587 | 60 |
| gp1-tax protein | HTLV 2 | gi|9626726:6-119 | 41 | 588 | 60 |
| gp1-tax protein | HTLV 2 | gi|9626726:6-119 | 40 | 589 | 60 |
| gp1-tax protein | HTLV 2 | gi|9626726:6-119 | 39 | 590 | 60 |
| gs1 | HTLV 2 | gi|9626726:316-8751 | 8136 | 591 | 60 |
| gs1 | HTLV 2 | gi|9626726:316-8751 | 7844 | 592 | 60 |
| gs1 | HTLV 2 | gi|9626726:316-8751 | 7700 | 593 | 60 |
| gs1 | HTLV 2 | gi|9626726:316-8751 | 7607 | 594 | 60 |
| gs1 | HTLV 2 | gi|9626726:316-8751 | 7467 | 595 | 60 |
| gs1 | HTLV 2 | gi|9626726:316-8751 | 6864 | 596 | 60 |
| gs1 | HTLV 2 | gi|9626726:316-8751 | 6510 | 597 | 60 |
| gs1 | HTLV 2 | gi|9626726:316-8751 | 6302 | 598 | 60 |
| gs1 | HTLV 2 | gi|9626726:316-8751 | 6038 | 599 | 60 |
| gs1 | HTLV 2 | gi|9626726:316-8751 | 5942 | 600 | 60 |
| Gag-Pro-Pol | HTLV 2 | gi|9626726:807-5187 | 4170 | 601 | 60 |
| Gag-Pro-Pol | HTLV 2 | gi|9626726:807-5187 | 4051 | 602 | 60 |

TABLE 1-continued

| Selected viral probes | | | | | |
|---|---|---|---|---|---|
| Gag-Pro-Pol | HTLV 2 | gi\|9626726:807-5187 | 3988 | 603 | 60 |
| Gag-Pro-Pol | HTLV 2 | gi\|9626726:807-5187 | 3878 | 604 | 60 |
| Gag-Pro-Pol | HTLV 2 | gi\|9626726:807-5187 | 3759 | 605 | 60 |
| Gag-Pro-Pol | HTLV 2 | gi\|9626726:807-5187 | 3580 | 606 | 60 |
| Gag-Pro-Pol | HTLV 2 | gi\|9626726:807-5187 | 3276 | 607 | 60 |
| Gag-Pro-Pol | HTLV 2 | gi\|9626726:807-5187 | 2797 | 608 | 60 |
| Gag-Pro-Pol | HTLV 2 | gi\|9626726:807-5187 | 2698 | 609 | 60 |
| Gag-Pro-Pol | HTLV 2 | gi\|9626726:807-5187 | 2471 | 610 | 60 |
| gp2-gag polyprotein | HTLV 2 | gi\|9626726:807-2108 | 927 | 611 | 60 |
| gp2-gag polyprotein | HTLV 2 | gi\|9626726:807-2108 | 924 | 612 | 60 |
| gp2-gag polyprotein | HTLV 2 | gi\|9626726:807-2108 | 923 | 613 | 60 |
| gp2-gag polyprotein | HTLV 2 | gi\|9626726:807-2108 | 910 | 614 | 60 |
| gp2-gag polyprotein | HTLV 2 | gi\|9626726:807-2108 | 909 | 615 | 60 |
| gp2-gag polyprotein | HTLV 2 | gi\|9626726:807-2108 | 908 | 616 | 60 |
| gp2-gag polyprotein | HTLV 2 | gi\|9626726:807-2108 | 904 | 617 | 60 |
| gp2-gag polyprotein | HTLV 2 | gi\|9626726:807-2108 | 903 | 618 | 60 |
| gp2-gag polyprotein | HTLV 2 | gi\|9626726:807-2108 | 902 | 619 | 60 |
| gp2-gag polyprotein | HTLV 2 | gi\|9626726:807-2108 | 901 | 620 | 60 |
| gp4-rex 26 kD protein | HTLV 2 | gi\|9626726:5121-7663 | 2053 | 621 | 60 |
| gp4-rex 26 kD protein | HTLV 2 | gi\|9626726:5121-7663 | 2003 | 622 | 60 |
| gp4-rex 26 kD protein | HTLV 2 | gi\|9626726:5121-7663 | 1705 | 623 | 60 |
| gp4-rex 26 kD protein | HTLV 2 | gi\|9626726:5121-7663 | 1488 | 624 | 60 |
| gp4-rex 26 kD protein | HTLV 2 | gi\|9626726:5121-7663 | 1219 | 625 | 60 |
| gp4-rex 26 kD protein | HTLV 2 | gi\|9626726:5121-7663 | 1132 | 626 | 60 |
| gp4-rex 26 kD protein | HTLV 2 | gi\|9626726:5121-7663 | 1092 | 627 | 60 |
| gp4-rex 26 kD protein | HTLV 2 | gi\|9626726:5121-7663 | 680 | 628 | 60 |
| gp4-rex 26 kD protein | HTLV 2 | gi\|9626726:5121-7663 | 455 | 629 | 60 |
| gp4-rex 26 kD protein | HTLV 2 | gi\|9626726:5121-7663 | 293 | 630 | 60 |
| gp5-tax protein | HTLV 2 | gi\|9626726:5180-8205 | 2967 | 631 | 60 |
| gp5-tax protein | HTLV 2 | gi\|9626726:5180-8205 | 2836 | 632 | 60 |
| gp5-tax protein | HTLV 2 | gi\|9626726:5180-8205 | 2743 | 633 | 60 |
| gp5-tax protein | HTLV 2 | gi\|9626726:5180-8205 | 2603 | 634 | 60 |
| gp5-tax protein | HTLV 2 | gi\|9626726:5180-8205 | 2000 | 635 | 60 |
| gp5-tax protein | HTLV 2 | gi\|9626726:5180-8205 | 1646 | 636 | 60 |
| gp5-tax protein | HTLV 2 | gi\|9626726:5180-8205 | 1438 | 637 | 60 |
| gp5-tax protein | HTLV 2 | gi\|9626726:5180-8205 | 1174 | 638 | 60 |
| gp5-tax protein | HTLV 2 | gi\|9626726:5180-8205 | 1078 | 639 | 60 |
| gp5-tax protein | HTLV 2 | gi\|9626726:5180-8205 | 624 | 640 | 60 |
| gp6-env peptide | HTLV 2 | gi\|9626726:5180-6640 | 1402 | 641 | 60 |
| gp6-env peptide | HTLV 2 | gi\|9626726:5180-6640 | 1160 | 642 | 60 |
| gp6-env peptide | HTLV 2 | gi\|9626726:5180-6640 | 1073 | 643 | 60 |
| gp6-env peptide | HTLV 2 | gi\|9626726:5180-6640 | 1033 | 644 | 60 |
| gp6-env peptide | HTLV 2 | gi\|9626726:5180-6640 | 621 | 645 | 60 |
| gp6-env peptide | HTLV 2 | gi\|9626726:5180-6640 | 599 | 646 | 60 |
| gp6-env peptide | HTLV 2 | gi\|9626726:5180-6640 | 396 | 647 | 60 |
| gp6-env peptide | HTLV 2 | gi\|9626726:5180-6640 | 375 | 648 | 60 |
| gp6-env peptide | HTLV 2 | gi\|9626726:5180-6640 | 234 | 649 | 60 |
| gp6-env peptide | HTLV 2 | gi\|9626726:5180-6640 | 6 | 650 | 60 |
| 3 LTR | HTLV 2 | gi\|9626726:8190-8952 | 262 | 651 | 60 |
| 3 LTR | HTLV 2 | gi\|9626726:8190-8952 | 261 | 652 | 60 |
| 3 LTR | HTLV 2 | gi\|9626726:8190-8952 | 260 | 653 | 60 |
| 3 LTR | HTLV 2 | gi\|9626726:8190-8952 | 258 | 654 | 60 |
| 3 LTR | HTLV 2 | gi\|9626726:8190-8952 | 257 | 655 | 60 |
| 3 LTR | HTLV 2 | gi\|9626726:8190-8952 | 256 | 656 | 60 |
| 3 LTR | HTLV 2 | gi\|9626726:8190-8952 | 255 | 657 | 60 |
| 3 LTR | HTLV 2 | gi\|9626726:8190-8952 | 254 | 658 | 60 |
| 3 LTR | HTLV 2 | gi\|9626726:8190-8952 | 253 | 659 | 60 |
| 3 LTR | HTLV 2 | gi\|9626726:8190-8952 | 251 | 660 | 60 |

TABLE 1-continued

| Selected viral probes | | | | | |
|---|---|---|---|---|---|
| anchored capsid protein C | WNV NY99 | gi\|158516887:97-465 | 299 | 661 | 60 |
| anchored capsid protein C | WNV NY99 | gi\|158516887:97-465 | 298 | 662 | 60 |
| anchored capsid protein C | WNV NY99 | gi\|158516887:97-465 | 297 | 663 | 60 |
| anchored capsid protein C | WNV NY99 | gi\|158516887:97-465 | 296 | 664 | 60 |
| anchored capsid protein C | WNV NY99 | gi\|158516887:97-465 | 295 | 665 | 60 |
| anchored capsid protein C | WNV NY99 | gi\|158516887:97-465 | 294 | 666 | 60 |
| anchored capsid protein C | WNV NY99 | gi\|158516887:97-465 | 286 | 667 | 60 |
| anchored capsid protein C | WNV NY99 | gi\|158516887:97-465 | 282 | 668 | 60 |
| anchored capsid protein C | WNV NY99 | gi\|158516887:97-465 | 281 | 669 | 60 |
| anchored capsid protein C | WNV NY99 | gi\|158516887:97-465 | 279 | 670 | 60 |
| membrane glycoprotein precursor prM | WNV NY99 | gi\|158516887:466-966 | 355 | 671 | 60 |
| membrane glycoprotein precursor prM | WNV NY99 | gi\|158516887:466-966 | 354 | 672 | 60 |
| membrane glycoprotein precursor prM | WNV NY99 | gi\|158516887:466-966 | 353 | 673 | 60 |
| membrane glycoprotein precursor prM | WNV NY99 | gi\|158516887:466-966 | 352 | 674 | 60 |
| membrane glycoprotein precursor prM | WNV NY99 | gi\|158516887:466-966 | 351 | 675 | 60 |
| membrane glycoprotein precursor prM | WNV NY99 | gi\|158516887:466-966 | 350 | 676 | 60 |
| membrane glycoprotein precursor prM | WNV NY99 | gi\|158516887:466-966 | 349 | 677 | 60 |
| membrane glycoprotein precursor prM | WNV NY99 | gi\|158516887:466-966 | 348 | 678 | 60 |
| membrane glycoprotein precursor prM | WNV NY99 | gi\|158516887:466-966 | 347 | 679 | 60 |
| membrane glycoprotein precursor prM | WNV NY99 | gi\|158516887:466-966 | 346 | 680 | 60 |
| envelope protein E | WNV NY99 | gi\|158516887:967-2469 | 1168 | 681 | 60 |
| envelope protein E | WNV NY99 | gi\|158516887:967-2469 | 880 | 682 | 60 |
| envelope protein E | WNV NY99 | gi\|158516887:967-2469 | 850 | 683 | 60 |
| envelope protein E | WNV NY99 | gi\|158516887:967-2469 | 820 | 684 | 60 |
| envelope protein E | WNV NY99 | gi\|158516887:967-2469 | 788 | 685 | 60 |
| envelope protein E | WNV NY99 | gi\|158516887:967-2469 | 595 | 686 | 60 |
| envelope protein E | WNV NY99 | gi\|158516887:967-2469 | 393 | 687 | 60 |
| envelope protein E | WNV NY99 | gi\|158516887:967-2469 | 363 | 688 | 60 |
| envelope protein E | WNV NY99 | gi\|158516887:967-2469 | 319 | 689 | 60 |
| envelope protein E | WNV NY99 | gi\|158516887:967-2469 | 90 | 690 | 60 |
| nonstructural protein NS1 | WNV NY99 | gi\|158516887:2470-3525 | 971 | 691 | 60 |
| nonstructural protein NS1 | WNV NY99 | gi\|158516887:2470-3525 | 598 | 692 | 60 |
| nonstructural protein NS1 | WNV NY99 | gi\|158516887:2470-3525 | 566 | 693 | 60 |
| nonstructural protein NS1 | WNV NY99 | gi\|158516887:2470-3525 | 517 | 694 | 60 |

TABLE 1-continued

| Selected viral probes | | | | | |
|---|---|---|---|---|---|
| nonstructural protein NS1 | WNV NY99 | gi\|158516887:2470-3525 | 426 | 695 | 60 |
| nonstructural protein NS1 | WNV NY99 | gi\|158516887:2470-3525 | 357 | 696 | 60 |
| nonstructural protein NS1 | WNV NY99 | gi\|158516887:2470-3525 | 325 | 697 | 60 |
| nonstructural protein NS1 | WNV NY99 | gi\|158516887:2470-3525 | 130 | 698 | 60 |
| nonstructural protein NS1 | WNV NY99 | gi\|158516887:2470-3525 | 97 | 699 | 60 |
| nonstructural protein NS1 | WNV NY99 | gi\|158516887:2470-3525 | 54 | 700 | 60 |
| nonstructural protein NS2A | WNV NY99 | gi\|158516887:3526-4218 | 584 | 701 | 60 |
| nonstructural protein NS2A | WNV NY99 | gi\|158516887:3526-4218 | 501 | 702 | 60 |
| nonstructural protein NS2A | WNV NY99 | gi\|158516887:3526-4218 | 413 | 703 | 60 |
| nonstructural protein NS2A | WNV NY99 | gi\|158516887:3526-4218 | 393 | 704 | 60 |
| nonstructural protein NS2A | WNV NY99 | gi\|158516887:3526-4218 | 313 | 705 | 60 |
| nonstructural protein NS2A | WNV NY99 | gi\|158516887:3526-4218 | 293 | 706 | 60 |
| nonstructural protein NS2A | WNV NY99 | gi\|158516887:3526-4218 | 265 | 707 | 60 |
| nonstructural protein NS2A | WNV NY99 | gi\|158516887:3526-4218 | 243 | 708 | 60 |
| nonstructural protein NS2A | WNV NY99 | gi\|158516887:3526-4218 | 147 | 709 | 60 |
| nonstructural protein NS2A | WNV NY99 | gi\|158516887:3526-4218 | 106 | 710 | 60 |
| nonstructural protein NS2B | WNV NY99 | gi\|158516887:4219-4611 | 334 | 711 | 60 |
| nonstructural protein NS2B | WNV NY99 | gi\|158516887:4219-4611 | 249 | 712 | 60 |
| nonstructural protein NS2B | WNV NY99 | gi\|158516887:4219-4611 | 246 | 713 | 60 |
| nonstructural protein NS2B | WNV NY99 | gi\|158516887:4219-4611 | 245 | 714 | 60 |
| nonstructural protein NS2B | WNV NY99 | gi\|158516887:4219-4611 | 242 | 715 | 60 |
| nonstructural protein NS2B | WNV NY99 | gi\|158516887:4219-4611 | 240 | 716 | 60 |
| nonstructural protein NS2B | WNV NY99 | gi\|158516887:4219-4611 | 239 | 717 | 60 |
| nonstructural protein NS2B | WNV NY99 | gi\|158516887:4219-4611 | 238 | 718 | 60 |
| nonstructural protein NS2B | WNV NY99 | gi\|158516887:4219-4611 | 237 | 719 | 60 |
| nonstructural protein NS2B | WNV NY99 | gi\|158516887:4219-4611 | 236 | 720 | 60 |
| nonstructural protein NS3 | WNV NY99 | gi\|158516887:4612-6468 | 1721 | 721 | 60 |
| nonstructural protein NS3 | WNV NY99 | gi\|158516887:4612-6468 | 1591 | 722 | 60 |
| nonstructural protein NS3 | WNV NY99 | gi\|158516887:4612-6468 | 1512 | 723 | 60 |
| nonstructural protein NS3 | WNV NY99 | gi\|158516887:4612-6468 | 1217 | 724 | 60 |
| nonstructural protein NS3 | WNV NY99 | gi\|158516887:4612-6468 | 1157 | 725 | 60 |
| nonstructural protein NS3 | WNV NY99 | gi\|158516887:4612-6468 | 1097 | 726 | 60 |
| nonstructural protein NS3 | WNV NY99 | gi\|158516887:4612-6468 | 960 | 727 | 60 |
| nonstructural protein NS3 | WNV NY99 | gi\|158516887:4612-6468 | 757 | 728 | 60 |
| nonstructural protein NS3 | WNV NY99 | gi\|158516887:4612-6468 | 600 | 729 | 60 |
| nonstructural protein NS3 | WNV NY99 | gi\|158516887:4612-6468 | 428 | 730 | 60 |
| nonstructural protein NS4A | WNV NY99 | gi\|158516887:6469-6834 | 160 | 731 | 60 |
| nonstructural protein NS4A | WNV NY99 | gi\|158516887:6469-6834 | 159 | 732 | 60 |
| nonstructural protein NS4A | WNV NY99 | gi\|158516887:6469-6834 | 158 | 733 | 60 |

TABLE 1-continued

| Selected viral probes | | | | | |
|---|---|---|---|---|---|
| nonstructural protein NS4A | WNV NY99 | gi|158516887:6469-6834 | 157 | 734 | 60 |
| nonstructural protein NS4A | WNV NY99 | gi|158516887:6469-6834 | 156 | 735 | 60 |
| nonstructural protein NS4A | WNV NY99 | gi|158516887:6469-6834 | 155 | 736 | 60 |
| nonstructural protein NS4A | WNV NY99 | gi|158516887:6469-6834 | 154 | 737 | 60 |
| nonstructural protein NS4A | WNV NY99 | gi|158516887:6469-6834 | 153 | 738 | 60 |
| nonstructural protein NS4A | WNV NY99 | gi|158516887:6469-6834 | 152 | 739 | 60 |
| nonstructural protein NS4A | WNV NY99 | gi|158516887:6469-6834 | 151 | 740 | 60 |
| nonstructural protein NS4B | WNV NY99 | gi|158516887:6916-7680 | 703 | 741 | 60 |
| nonstructural protein NS4B | WNV NY99 | gi|158516887:6916-7680 | 683 | 742 | 60 |
| nonstructural protein NS4B | WNV NY99 | gi|158516887:6916-7680 | 506 | 743 | 60 |
| nonstructural protein NS4B | WNV NY99 | gi|158516887:6916-7680 | 480 | 744 | 60 |
| nonstructural protein NS4B | WNV NY99 | gi|158516887:6916-7680 | 185 | 745 | 60 |
| nonstructural protein NS4B | WNV NY99 | gi|158516887:6916-7680 | 165 | 746 | 60 |
| nonstructural protein NS4B | WNV NY99 | gi|158516887:6916-7680 | 140 | 747 | 60 |
| nonstructural protein NS4B | WNV NY99 | gi|158516887:6916-7680 | 48 | 748 | 60 |
| nonstructural protein NS4B | WNV NY99 | gi|158516887:6916-7680 | 28 | 749 | 60 |
| nonstructural protein NS4B | WNV NY99 | gi|158516887:6916-7680 | 8 | 750 | 60 |
| nonstructural protein NS5 | WNV NY99 | gi|158516887:7681-10395 | 2656 | 751 | 60 |
| nonstructural protein NS6 | WNV NY99 | gi|158516887:7681-10395 | 2596 | 752 | 60 |
| nonstructural protein NS7 | WNV NY99 | gi|158516887:7681-10395 | 2480 | 753 | 60 |
| nonstructural protein NS8 | WNV NY99 | gi|158516887:7681-10395 | 2161 | 754 | 60 |
| nonstructural protein NS9 | WNV NY99 | gi|158516887:7681-10395 | 2101 | 755 | 60 |
| nonstructural protein NS10 | WNV NY99 | gi|158516887:7681-10395 | 1353 | 756 | 60 |
| nonstructural protein NS11 | WNV NY99 | gi|158516887:7681-10395 | 1255 | 757 | 60 |
| nonstructural protein NS12 | WNV NY99 | gi|158516887:7681-10395 | 1195 | 758 | 60 |
| nonstructural protein NS13 | WNV NY99 | gi|158516887:7681-10395 | 720 | 759 | 60 |
| nonstructural protein NS14 | WNV NY99 | gi|158516887:7681-10395 | 365 | 760 | 60 |
| anchored capsid protein C | WNV 956 | gi|11528013:97-465 | 256 | 761 | 60 |
| anchored capsid protein C | WNV 956 | gi|11528013:97-465 | 254 | 762 | 60 |
| anchored capsid protein C | WNV 956 | gi|11528013:97-465 | 253 | 763 | 60 |
| anchored capsid protein C | WNV 956 | gi|11528013:97-465 | 249 | 764 | 60 |
| anchored capsid protein C | WNV 956 | gi|11528013:97-465 | 232 | 765 | 60 |
| anchored capsid protein C | WNV 956 | gi|11528013:97-465 | 231 | 766 | 60 |
| anchored capsid protein C | WNV 956 | gi|11528013:97-465 | 230 | 767 | 60 |
| anchored capsid protein C | WNV 956 | gi|11528013:97-465 | 229 | 768 | 60 |
| anchored capsid protein C | WNV 956 | gi|11528013:97-465 | 228 | 769 | 60 |
| anchored capsid protein C | WNV 956 | gi|11528013:97-465 | 227 | 770 | 60 |
| membrane glycoprotein precursor prM | WNV 956 | gi|11528013:466-966 | 417 | 771 | 60 |

TABLE 1-continued

| Selected viral probes | | | | | |
|---|---|---|---|---|---|
| membrane glycoprotein precursor prM | WNV 956 | gi\|11528013:466-966 | 335 | 772 | 60 |
| membrane glycoprotein precursor prM | WNV 956 | gi\|11528013:466-966 | 334 | 773 | 60 |
| membrane glycoprotein precursor prM | WNV 956 | gi\|11528013:466-966 | 333 | 774 | 60 |
| membrane glycoprotein precursor prM | WNV 956 | gi\|11528013:466-966 | 332 | 775 | 60 |
| membrane glycoprotein precursor prM | WNV 956 | gi\|11528013:466-966 | 331 | 776 | 60 |
| membrane glycoprotein precursor prM | WNV 956 | gi\|11528013:466-966 | 330 | 777 | 60 |
| membrane glycoprotein precursor prM | WNV 956 | gi\|11528013:466-966 | 329 | 778 | 60 |
| membrane glycoprotein precursor prM | WNV 956 | gi\|11528013:466-966 | 327 | 779 | 60 |
| membrane glycoprotein precursor prM | WNV 956 | gi\|11528013:466-966 | 320 | 780 | 60 |
| membrane glycoprotein M | WNV 956 | gi\|11528013:742-966 | 141 | 781 | 60 |
| membrane glycoprotein M | WNV 956 | gi\|11528013:742-966 | 59 | 782 | 60 |
| membrane glycoprotein M | WNV 956 | gi\|11528013:742-966 | 58 | 783 | 60 |
| membrane glycoprotein M | WNV 956 | gi\|11528013:742-966 | 57 | 784 | 60 |
| membrane glycoprotein M | WNV 956 | gi\|11528013:742-966 | 56 | 785 | 60 |
| membrane glycoprotein M | WNV 956 | gi\|11528013:742-966 | 55 | 786 | 60 |
| membrane glycoprotein M | WNV 956 | gi\|11528013:742-966 | 54 | 787 | 60 |
| membrane glycoprotein M | WNV 956 | gi\|11528013:742-966 | 53 | 788 | 60 |
| membrane glycoprotein M | WNV 956 | gi\|11528013:742-966 | 51 | 789 | 60 |
| membrane glycoprotein M | WNV 956 | gi\|11528013:742-966 | 44 | 790 | 60 |
| envelope protein E | WNV 956 | gi\|11528013:967-2457 | 1312 | 791 | 60 |
| envelope protein E | WNV 956 | gi\|11528013:967-2457 | 885 | 792 | 60 |
| envelope protein E | WNV 956 | gi\|11528013:967-2457 | 813 | 793 | 60 |
| envelope protein E | WNV 956 | gi\|11528013:967-2457 | 698 | 794 | 60 |
| envelope protein E | WNV 956 | gi\|11528013:967-2457 | 597 | 795 | 60 |
| envelope protein E | WNV 956 | gi\|11528013:967-2457 | 483 | 796 | 60 |
| envelope protein E | WNV 956 | gi\|11528013:967-2457 | 397 | 797 | 60 |
| envelope protein E | WNV 956 | gi\|11528013:967-2457 | 337 | 798 | 60 |
| envelope protein E | WNV 956 | gi\|11528013:967-2457 | 123 | 799 | 60 |
| envelope protein E | WNV 956 | gi\|11528013:967-2457 | 63 | 800 | 60 |
| nonstructural protein NS1 | WNV 956 | gi\|11528013:2458-3513 | 829 | 801 | 60 |
| nonstructural protein NS1 | WNV 956 | gi\|11528013:2458-3513 | 827 | 802 | 60 |
| nonstructural protein NS1 | WNV 956 | gi\|11528013:2458-3513 | 826 | 803 | 60 |
| nonstructural protein NS1 | WNV 956 | gi\|11528013:2458-3513 | 825 | 804 | 60 |

TABLE 1-continued

Selected viral probes

| | | | | | |
|---|---|---|---|---|---|
| nonstructural protein NS1 | WNV 956 | gi\|11528013:2458-3513 | 824 | 805 | 60 |
| nonstructural protein NS1 | WNV 956 | gi\|11528013:2458-3513 | 823 | 806 | 60 |
| nonstructural protein NS1 | WNV 956 | gi\|11528013:2458-3513 | 822 | 807 | 60 |
| nonstructural protein NS1 | WNV 956 | gi\|11528013:2458-3513 | 821 | 808 | 60 |
| nonstructural protein NS1 | WNV 956 | gi\|11528013:2458-3513 | 820 | 809 | 60 |
| nonstructural protein NS1 | WNV 956 | gi\|11528013:2458-3513 | 819 | 810 | 60 |
| nonstructural protein NS2A | WNV 956 | gi\|11528013:3514-4206 | 556 | 811 | 60 |
| nonstructural protein NS2A | WNV 956 | gi\|11528013:3514-4206 | 536 | 812 | 60 |
| nonstructural protein NS2A | WNV 956 | gi\|11528013:3514-4206 | 516 | 813 | 60 |
| nonstructural protein NS2A | WNV 956 | gi\|11528013:3514-4206 | 496 | 814 | 60 |
| nonstructural protein NS2A | WNV 956 | gi\|11528013:3514-4206 | 476 | 815 | 60 |
| nonstructural protein NS2A | WNV 956 | gi\|11528013:3514-4206 | 401 | 816 | 60 |
| nonstructural protein NS2A | WNV 956 | gi\|11528013:3514-4206 | 345 | 817 | 60 |
| nonstructural protein NS2A | WNV 956 | gi\|11528013:3514-4206 | 325 | 818 | 60 |
| nonstructural protein NS2A | WNV 956 | gi\|11528013:3514-4206 | 305 | 819 | 60 |
| nonstructural protein NS2A | WNV 956 | gi\|11528013:3514-4206 | 279 | 820 | 60 |
| nonstructural protein NS2B | WNV 956 | gi\|11528013:4207-4599 | 249 | 821 | 60 |
| nonstructural protein NS2B | WNV 956 | gi\|11528013:4207-4599 | 248 | 822 | 60 |
| nonstructural protein NS2B | WNV 956 | gi\|11528013:4207-4599 | 247 | 823 | 60 |
| nonstructural protein NS2B | WNV 956 | gi\|11528013:4207-4599 | 246 | 824 | 60 |
| nonstructural protein NS2B | WNV 956 | gi\|11528013:4207-4599 | 245 | 825 | 60 |
| nonstructural protein NS2B | WNV 956 | gi\|11528013:4207-4599 | 244 | 826 | 60 |
| nonstructural protein NS2B | WNV 956 | gi\|11528013:4207-4599 | 243 | 827 | 60 |
| nonstructural protein NS2B | WNV 956 | gi\|11528013:4207-4599 | 242 | 828 | 60 |
| nonstructural protein NS2B | WNV 956 | gi\|11528013:4207-4599 | 241 | 829 | 60 |
| nonstructural protein NS2B | WNV 956 | gi\|11528013:4207-4599 | 240 | 830 | 60 |
| nonstructural protein NS3 | WNV 956 | gi\|11528013:4600-6456 | 1798 | 831 | 60 |
| nonstructural protein NS3 | WNV 956 | gi\|11528013:4600-6456 | 1729 | 832 | 60 |
| nonstructural protein NS3 | WNV 956 | gi\|11528013:4600-6456 | 1668 | 833 | 60 |
| nonstructural protein NS3 | WNV 956 | gi\|11528013:4600-6456 | 1597 | 834 | 60 |
| nonstructural protein NS3 | WNV 956 | gi\|11528013:4600-6456 | 1437 | 835 | 60 |
| nonstructural protein NS3 | WNV 956 | gi\|11528013:4600-6456 | 1212 | 836 | 60 |
| nonstructural protein NS3 | WNV 956 | gi\|11528013:4600-6456 | 1150 | 837 | 60 |
| nonstructural protein NS3 | WNV 956 | gi\|11528013:4600-6456 | 1073 | 838 | 60 |
| nonstructural protein NS3 | WNV 956 | gi\|11528013:4600-6456 | 1013 | 839 | 60 |
| nonstructural protein NS3 | WNV 956 | gi\|11528013:4600-6456 | 809 | 840 | 60 |
| nonstructural protein NS4A | WNV 956 | gi\|11528013:6457-6834 | 206 | 841 | 60 |
| nonstructural protein NS4A | WNV 956 | gi\|11528013:6457-6834 | 205 | 842 | 60 |
| nonstructural protein NS4A | WNV 956 | gi\|11528013:6457-6834 | 204 | 843 | 60 |

TABLE 1-continued

| Selected viral probes | | | | | |
|---|---|---|---|---|---|
| nonstructural protein NS4A | WNV 956 | gi\|11528013:6457-6834 | 203 | 844 | 60 |
| nonstructural protein NS4A | WNV 956 | gi\|11528013:6457-6834 | 202 | 845 | 60 |
| nonstructural protein NS4A | WNV 956 | gi\|11528013:6457-6834 | 201 | 846 | 60 |
| nonstructural protein NS4A | WNV 956 | gi\|11528013:6457-6834 | 200 | 847 | 60 |
| nonstructural protein NS4A | WNV 956 | gi\|11528013:6457-6834 | 199 | 848 | 60 |
| nonstructural protein NS4A | WNV 956 | gi\|11528013:6457-6834 | 198 | 849 | 60 |
| nonstructural protein NS4A | WNV 956 | gi\|11528013:6457-6834 | 197 | 850 | 60 |
| nonstructural protein NS4B | WNV 956 | gi\|11528013:6904-7671 | 517 | 851 | 60 |
| nonstructural protein NS4B | WNV 956 | gi\|11528013:6904-7671 | 513 | 852 | 60 |
| nonstructural protein NS4B | WNV 956 | gi\|11528013:6904-7671 | 512 | 853 | 60 |
| nonstructural protein NS4B | WNV 956 | gi\|11528013:6904-7671 | 511 | 854 | 60 |
| nonstructural protein NS4B | WNV 956 | gi\|11528013:6904-7671 | 510 | 855 | 60 |
| nonstructural protein NS4B | WNV 956 | gi\|11528013:6904-7671 | 509 | 856 | 60 |
| nonstructural protein NS4B | WNV 956 | gi\|11528013:6904-7671 | 508 | 857 | 60 |
| nonstructural protein NS4B | WNV 956 | gi\|11528013:6904-7671 | 507 | 858 | 60 |
| nonstructural protein NS4B | WNV 956 | gi\|11528013:6904-7671 | 506 | 859 | 60 |
| nonstructural protein NS4B | WNV 956 | gi\|11528013:6904-7671 | 505 | 860 | 60 |
| nonstructural protein NS5 | WNV 956 | gi\|11528013:7672-10386 | 2656 | 861 | 60 |
| nonstructural protein NS5 | WNV 956 | gi\|11528013:7672-10386 | 2596 | 862 | 60 |
| nonstructural protein NS5 | WNV 956 | gi\|11528013:7672-10386 | 2495 | 863 | 60 |
| nonstructural protein NS5 | WNV 956 | gi\|11528013:7672-10386 | 2116 | 864 | 60 |
| nonstructural protein NS5 | WNV 956 | gi\|11528013:7672-10386 | 2048 | 865 | 60 |
| nonstructural protein NS5 | WNV 956 | gi\|11528013:7672-10386 | 1908 | 866 | 60 |
| nonstructural protein NS5 | WNV 956 | gi\|11528013:7672-10386 | 1555 | 867 | 60 |
| nonstructural protein NS5 | WNV 956 | gi\|11528013:7672-10386 | 1354 | 868 | 60 |
| nonstructural protein NS5 | WNV 956 | gi\|11528013:7672-10386 | 1241 | 869 | 60 |
| nonstructural protein NS5 | WNV 956 | gi\|11528013:7672-10386 | 1170 | 870 | 60 |
| gp1-nonstructural polyprotein | Chikungunya | gi\|27754751:77-7501 | 7323 | 871 | 60 |
| gp1-nonstructural polyprotein | Chikungunya | gi\|27754751:77-7501 | 7262 | 872 | 60 |
| gp1-nonstructural polyprotein | Chikungunya | gi\|27754751:77-7501 | 7166 | 873 | 60 |
| gp1-nonstructural polyprotein | Chikungunya | gi\|27754751:77-7501 | 7088 | 874 | 60 |
| gp1-nonstructural polyprotein | Chikungunya | gi\|27754751:77-7501 | 7016 | 875 | 60 |
| gp1-nonstructural polyprotein | Chikungunya | gi\|27754751:77-7501 | 6874 | 876 | 60 |
| gp1-nonstructural polyprotein | Chikungunya | gi\|27754751:77-7501 | 6745 | 877 | 60 |
| gp1-nonstructural polyprotein | Chikungunya | gi\|27754751:77-7501 | 6685 | 878 | 60 |

TABLE 1-continued

| Selected viral probes | | | | | |
|---|---|---|---|---|---|
| gp1-nonstructural polyprotein | Chikungunya | gi\|27754751:77-7501 | 6617 | 879 | 60 |
| gp1-nonstructural polyprotein | Chikungunya | gi\|27754751:77-7501 | 6468 | 880 | 60 |
| gp2-structural polyprotein | Chikungunya | gi\|27754751:7567-11313 | 3441 | 881 | 60 |
| gp2-structural polyprotein | Chikungunya | gi\|27754751:7567-11313 | 3376 | 882 | 60 |
| gp2-structural polyprotein | Chikungunya | gi\|27754751:7567-11313 | 3109 | 883 | 60 |
| gp2-structural polyprotein | Chikungunya | gi\|27754751:7567-11313 | 2945 | 884 | 60 |
| gp2-structural polyprotein | Chikungunya | gi\|27754751:7567-11313 | 2815 | 885 | 60 |
| gp2-structural polyprotein | Chikungunya | gi\|27754751:7567-11313 | 2750 | 886 | 60 |
| gp2-structural polyprotein | Chikungunya | gi\|27754751:7567-11313 | 2552 | 887 | 60 |
| gp2-structural polyprotein | Chikungunya | gi\|27754751:7567-11313 | 2359 | 888 | 60 |
| gp2-structural polyprotein | Chikungunya | gi\|27754751:7567-11313 | 2052 | 889 | 60 |
| gp2-structural polyprotein | Chikungunya | gi\|27754751:7567-11313 | 1733 | 890 | 60 |
| gp3-truncated polyprotein | Chikungunya | gi\|27754751:7567-10040 | 2359 | 891 | 60 |
| gp3-truncated polyprotein | Chikungunya | gi\|27754751:7567-10040 | 2052 | 892 | 60 |
| gp3-truncated polyprotein | Chikungunya | gi\|27754751:7567-10040 | 1733 | 893 | 60 |
| gp3-truncated polyprotein | Chikungunya | gi\|27754751:7567-10040 | 1631 | 894 | 60 |
| gp3-truncated polyprotein | Chikungunya | gi\|27754751:7567-10040 | 1568 | 895 | 60 |
| gp3-truncated polyprotein | Chikungunya | gi\|27754751:7567-10040 | 1294 | 896 | 60 |
| gp3-truncated polyprotein | Chikungunya | gi\|27754751:7567-10040 | 1224 | 897 | 60 |
| gp3-truncated polyprotein | Chikungunya | gi\|27754751:7567-10040 | 1134 | 898 | 60 |
| gp3-truncated polyprotein | Chikungunya | gi\|27754751:7567-10040 | 988 | 899 | 60 |
| gp3-truncated polyprotein | Chikungunya | gi\|27754751:7567-10040 | 899 | 900 | 60 |
| anchored capsid protein C | DEN 1 | gi\|9626685:95-436 | 266 | 901 | 60 |
| anchored capsid protein C | DEN 1 | gi\|9626685:95-436 | 236 | 902 | 60 |
| anchored capsid protein C | DEN 1 | gi\|9626685:95-436 | 216 | 903 | 60 |
| anchored capsid protein C | DEN 1 | gi\|9626685:95-436 | 193 | 904 | 60 |
| anchored capsid protein C | DEN 1 | gi\|9626685:95-436 | 165 | 905 | 60 |
| anchored capsid protein C | DEN 1 | gi\|9626685:95-436 | 145 | 906 | 60 |
| anchored capsid protein C | DEN 1 | gi\|9626685:95-436 | 125 | 907 | 60 |
| anchored capsid protein C | DEN 1 | gi\|9626685:95-436 | 105 | 908 | 60 |
| anchored capsid protein C | DEN 1 | gi\|9626685:95-436 | 81 | 909 | 60 |
| anchored capsid protein C | DEN 1 | gi\|9626685:95-436 | 57 | 910 | 60 |
| membrane glycoprotein precursor M | DEN 1 | gi\|9626685:437-934 | 439 | 911 | 60 |
| membrane glycoprotein precursor M | DEN 1 | gi\|9626685:437-934 | 438 | 912 | 60 |
| membrane glycoprotein precursor M | DEN 1 | gi\|9626685:437-934 | 437 | 913 | 60 |
| membrane glycoprotein precursor M | DEN 1 | gi\|9626685:437-934 | 436 | 914 | 60 |

TABLE 1-continued

| Selected viral probes | | | | | |
|---|---|---|---|---|---|
| membrane glycoprotein precursor M | DEN 1 | gi\|9626685:437-934 | 435 | 915 | 60 |
| membrane glycoprotein precursor M | DEN 1 | gi\|9626685:437-934 | 434 | 916 | 60 |
| membrane glycoprotein precursor M | DEN 1 | gi\|9626685:437-934 | 433 | 917 | 60 |
| membrane glycoprotein precursor M | DEN 1 | gi\|9626685:437-934 | 432 | 918 | 60 |
| membrane glycoprotein precursor M | DEN 1 | gi\|9626685:437-934 | 431 | 919 | 60 |
| membrane glycoprotein precursor M | DEN 1 | gi\|9626685:437-934 | 430 | 920 | 60 |
| envelope protein E | DEN 1 | gi\|9626685:935-2419 | 1381 | 921 | 60 |
| envelope protein E | DEN 1 | gi\|9626685:935-2419 | 1319 | 922 | 60 |
| envelope protein E | DEN 1 | gi\|9626685:935-2419 | 1163 | 923 | 60 |
| envelope protein E | DEN 1 | gi\|9626685:935-2419 | 1082 | 924 | 60 |
| envelope protein E | DEN 1 | gi\|9626685:935-2419 | 954 | 925 | 60 |
| envelope protein E | DEN 1 | gi\|9626685:935-2419 | 892 | 926 | 60 |
| envelope protein E | DEN 1 | gi\|9626685:935-2419 | 820 | 927 | 60 |
| envelope protein E | DEN 1 | gi\|9626685:935-2419 | 734 | 928 | 60 |
| envelope protein E | DEN 1 | gi\|9626685:935-2419 | 674 | 929 | 60 |
| envelope protein E | DEN 1 | gi\|9626685:935-2419 | 550 | 930 | 60 |
| nonstructural protein NS1 | DEN 1 | gi\|9626685:2420-3475 | 997 | 931 | 60 |
| nonstructural protein NS1 | DEN 1 | gi\|9626685:2420-3475 | 897 | 932 | 60 |
| nonstructural protein NS1 | DEN 1 | gi\|9626685:2420-3475 | 837 | 933 | 60 |
| nonstructural protein NS1 | DEN 1 | gi\|9626685:2420-3475 | 777 | 934 | 60 |
| nonstructural protein NS1 | DEN 1 | gi\|9626685:2420-3475 | 717 | 935 | 60 |
| nonstructural protein NS1 | DEN 1 | gi\|9626685:2420-3475 | 656 | 936 | 60 |
| nonstructural protein NS1 | DEN 1 | gi\|9626685:2420-3475 | 596 | 937 | 60 |
| nonstructural protein NS1 | DEN 1 | gi\|9626685:2420-3475 | 496 | 938 | 60 |
| nonstructural protein NS1 | DEN 1 | gi\|9626685:2420-3475 | 436 | 939 | 60 |
| nonstructural protein NS1 | DEN 1 | gi\|9626685:2420-3475 | 359 | 940 | 60 |
| nonstructural protein NS2A | DEN 1 | gi\|9626685:3476-4129 | 592 | 941 | 60 |
| nonstructural protein NS2A | DEN 1 | gi\|9626685:3476-4129 | 517 | 942 | 60 |
| nonstructural protein NS2A | DEN 1 | gi\|9626685:3476-4129 | 477 | 943 | 60 |
| nonstructural protein NS2A | DEN 1 | gi\|9626685:3476-4129 | 437 | 944 | 60 |
| nonstructural protein NS2A | DEN 1 | gi\|9626685:3476-4129 | 397 | 945 | 60 |
| nonstructural protein NS2A | DEN 1 | gi\|9626685:3476-4129 | 357 | 946 | 60 |
| nonstructural protein NS2A | DEN 1 | gi\|9626685:3476-4129 | 309 | 947 | 60 |
| nonstructural protein NS2A | DEN 1 | gi\|9626685:3476-4129 | 269 | 948 | 60 |
| nonstructural protein NS2A | DEN 1 | gi\|9626685:3476-4129 | 131 | 949 | 60 |
| nonstructural protein NS2A | DEN 1 | gi\|9626685:3476-4129 | 86 | 950 | 60 |

TABLE 1-continued

| | | Selected viral probes | | | |
|---|---|---|---|---|---|
| nonstructural protein NS2B | DEN 1 | gi\|9626685:4130-4519 | 331 | 951 | 60 |
| nonstructural protein NS2B | DEN 1 | gi\|9626685:4130-4519 | 330 | 952 | 60 |
| nonstructural protein NS2B | DEN 1 | gi\|9626685:4130-4519 | 329 | 953 | 60 |
| nonstructural protein NS2B | DEN 1 | gi\|9626685:4130-4519 | 328 | 954 | 60 |
| nonstructural protein NS2B | DEN 1 | gi\|9626685:4130-4519 | 327 | 955 | 60 |
| nonstructural protein NS2B | DEN 1 | gi\|9626685:4130-4519 | 326 | 956 | 60 |
| nonstructural protein NS2B | DEN 1 | gi\|9626685:4130-4519 | 325 | 957 | 60 |
| nonstructural protein NS2B | DEN 1 | gi\|9626685:4130-4519 | 324 | 958 | 60 |
| nonstructural protein NS2B | DEN 1 | gi\|9626685:4130-4519 | 323 | 959 | 60 |
| nonstructural protein NS2B | DEN 1 | gi\|9626685:4130-4519 | 321 | 960 | 60 |
| nonstructural protein NS3 | DEN 1 | gi\|9626685:4520-6376 | 1475 | 961 | 60 |
| nonstructural protein NS3 | DEN 1 | gi\|9626685:4520-6376 | 1415 | 962 | 60 |
| nonstructural protein NS3 | DEN 1 | gi\|9626685:4520-6376 | 1213 | 963 | 60 |
| nonstructural protein NS3 | DEN 1 | gi\|9626685:4520-6376 | 1153 | 964 | 60 |
| nonstructural protein NS3 | DEN 1 | gi\|9626685:4520-6376 | 1093 | 965 | 60 |
| nonstructural protein NS3 | DEN 1 | gi\|9626685:4520-6376 | 1033 | 966 | 60 |
| nonstructural protein NS3 | DEN 1 | gi\|9626685:4520-6376 | 973 | 967 | 60 |
| nonstructural protein NS3 | DEN 1 | gi\|9626685:4520-6376 | 845 | 968 | 60 |
| nonstructural protein NS3 | DEN 1 | gi\|9626685:4520-6376 | 785 | 969 | 60 |
| nonstructural protein NS3 | DEN 1 | gi\|9626685:4520-6376 | 725 | 970 | 60 |
| nonstructural protein NS4A | DEN 1 | gi\|9626685:6377-6757 | 302 | 971 | 60 |
| nonstructural protein NS4A | DEN 1 | gi\|9626685:6377-6757 | 231 | 972 | 60 |
| nonstructural protein NS4A | DEN 1 | gi\|9626685:6377-6757 | 208 | 973 | 60 |
| nonstructural protein NS4A | DEN 1 | gi\|9626685:6377-6757 | 154 | 974 | 60 |
| nonstructural protein NS4A | DEN 1 | gi\|9626685:6377-6757 | 134 | 975 | 60 |
| nonstructural protein NS4A | DEN 1 | gi\|9626685:6377-6757 | 113 | 976 | 60 |
| nonstructural protein NS4A | DEN 1 | gi\|9626685:6377-6757 | 86 | 977 | 60 |
| nonstructural protein NS4A | DEN 1 | gi\|9626685:6377-6757 | 66 | 978 | 60 |
| nonstructural protein NS4A | DEN 1 | gi\|9626685:6377-6757 | 23 | 979 | 60 |
| nonstructural protein NS4A | DEN 1 | gi\|9626685:6377-6757 | 3 | 980 | 60 |
| nonstructural protein NS4B | DEN 1 | gi\|9626685:6827-7573 | 685 | 981 | 60 |
| nonstructural protein NS4B | DEN 1 | gi\|9626685:6827-7573 | 634 | 982 | 60 |
| nonstructural protein NS4B | DEN 1 | gi\|9626685:6827-7573 | 506 | 983 | 60 |
| nonstructural protein NS4B | DEN 1 | gi\|9626685:6827-7573 | 466 | 984 | 60 |
| nonstructural protein NS4B | DEN 1 | gi\|9626685:6827-7573 | 424 | 985 | 60 |
| nonstructural protein NS4B | DEN 1 | gi\|9626685:6827-7573 | 383 | 986 | 60 |
| nonstructural protein NS4B | DEN 1 | gi\|9626685:6827-7573 | 336 | 987 | 60 |
| nonstructural protein NS4B | DEN 1 | gi\|9626685:6827-7573 | 224 | 988 | 60 |
| nonstructural protein NS4B | DEN 1 | gi\|9626685:6827-7573 | 184 | 989 | 60 |

TABLE 1-continued

| Selected viral probes | | | | | |
|---|---|---|---|---|---|
| nonstructural protein NS4B | DEN 1 | gi\|9626685:6827-7573 | 144 | 990 | 60 |
| nonstructural protein NS5 | DEN 1 | gi\|9626685:7574-10270 | 2637 | 991 | 60 |
| nonstructural protein NS5 | DEN 1 | gi\|9626685:7574-10270 | 2577 | 992 | 60 |
| nonstructural protein NS5 | DEN 1 | gi\|9626685:7574-10270 | 2508 | 993 | 60 |
| nonstructural protein NS5 | DEN 1 | gi\|9626685:7574-10270 | 2425 | 994 | 60 |
| nonstructural protein NS5 | DEN 1 | gi\|9626685:7574-10270 | 2276 | 995 | 60 |
| nonstructural protein NS5 | DEN 1 | gi\|9626685:7574-10270 | 2102 | 996 | 60 |
| nonstructural protein NS5 | DEN 1 | gi\|9626685:7574-10270 | 2042 | 997 | 60 |
| nonstructural protein NS5 | DEN 1 | gi\|9626685:7574-10270 | 1982 | 998 | 60 |
| nonstructural protein NS5 | DEN 1 | gi\|9626685:7574-10270 | 1919 | 999 | 60 |
| nonstructural protein NS5 | DEN 1 | gi\|9626685:7574-10270 | 1857 | 1000 | 60 |
| anchored capsid protein C | DEN 2 | gi\|158976983:97-438 | 281 | 1001 | 60 |
| anchored capsid protein C | DEN 2 | gi\|158976983:97-438 | 280 | 1002 | 60 |
| anchored capsid protein C | DEN 2 | gi\|158976983:97-438 | 279 | 1003 | 60 |
| anchored capsid protein C | DEN 2 | gi\|158976983:97-438 | 278 | 1004 | 60 |
| anchored capsid protein C | DEN 2 | gi\|158976983:97-438 | 277 | 1005 | 60 |
| anchored capsid protein C | DEN 2 | gi\|158976983:97-438 | 276 | 1006 | 60 |
| anchored capsid protein C | DEN 2 | gi\|158976983:97-438 | 275 | 1007 | 60 |
| anchored capsid protein C | DEN 2 | gi\|158976983:97-438 | 274 | 1008 | 60 |
| anchored capsid protein C | DEN 2 | gi\|158976983:97-438 | 273 | 1009 | 60 |
| anchored capsid protein C | DEN 2 | gi\|158976983:97-438 | 272 | 1010 | 60 |
| membrane glycoprotein precursor M | DEN 2 | gi\|158976983:439-936 | 439 | 1011 | 60 |
| membrane glycoprotein precursor M | DEN 2 | gi\|158976983:439-936 | 419 | 1012 | 60 |
| membrane glycoprotein precursor M | DEN 2 | gi\|158976983:439-936 | 366 | 1013 | 60 |
| membrane glycoprotein precursor M | DEN 2 | gi\|158976983:439-936 | 334 | 1014 | 60 |
| membrane glycoprotein precursor M | DEN 2 | gi\|158976983:439-936 | 314 | 1015 | 60 |
| membrane glycoprotein precursor M | DEN 2 | gi\|158976983:439-936 | 254 | 1016 | 60 |
| membrane glycoprotein precursor M | DEN 2 | gi\|158976983:439-936 | 229 | 1017 | 60 |
| membrane glycoprotein precursor M | DEN 2 | gi\|158976983:439-936 | 60 | 1018 | 60 |
| membrane glycoprotein precursor M | DEN 2 | gi\|158976983:439-936 | 40 | 1019 | 60 |
| membrane glycoprotein precursor M | DEN 2 | gi\|158976983:439-936 | 20 | 1020 | 60 |
| envelope protein E | DEN 2 | gi\|158976983:937-2421 | 1422 | 1021 | 60 |
| envelope protein E | DEN 2 | gi\|158976983:937-2421 | 1362 | 1022 | 60 |
| envelope protein E | DEN 2 | gi\|158976983:937-2421 | 1286 | 1023 | 60 |

TABLE 1-continued

Selected viral probes

| | | | | | |
|---|---|---|---|---|---|
| envelope protein E | DEN 2 | gi\|158976983:937-2421 | 1186 | 1024 | 60 |
| envelope protein E | DEN 2 | gi\|158976983:937-2421 | 1126 | 1025 | 60 |
| envelope protein E | DEN 2 | gi\|158976983:937-2421 | 1066 | 1026 | 60 |
| envelope protein E | DEN 2 | gi\|158976983:937-2421 | 1006 | 1027 | 60 |
| envelope protein E | DEN 2 | gi\|158976983:937-2421 | 946 | 1028 | 60 |
| envelope protein E | DEN 2 | gi\|158976983:937-2421 | 886 | 1029 | 60 |
| envelope protein E | DEN 2 | gi\|158976983:937-2421 | 826 | 1030 | 60 |
| nonstructural protein NS1 | DEN 2 | gi\|158976983:2422-3477 | 997 | 1031 | 60 |
| nonstructural protein NS1 | DEN 2 | gi\|158976983:2422-3477 | 916 | 1032 | 60 |
| nonstructural protein NS1 | DEN 2 | gi\|158976983:2422-3477 | 827 | 1033 | 60 |
| nonstructural protein NS1 | DEN 2 | gi\|158976983:2422-3477 | 767 | 1034 | 60 |
| nonstructural protein NS1 | DEN 2 | gi\|158976983:2422-3477 | 707 | 1035 | 60 |
| nonstructural protein NS1 | DEN 2 | gi\|158976983:2422-3477 | 647 | 1036 | 60 |
| nonstructural protein NS1 | DEN 2 | gi\|158976983:2422-3477 | 587 | 1037 | 60 |
| nonstructural protein NS1 | DEN 2 | gi\|158976983:2422-3477 | 520 | 1038 | 60 |
| nonstructural protein NS1 | DEN 2 | gi\|158976983:2422-3477 | 460 | 1039 | 60 |
| nonstructural protein NS1 | DEN 2 | gi\|158976983:2422-3477 | 362 | 1040 | 60 |
| nonstructural protein NS2A | DEN 2 | gi\|158976983:3478-4131 | 550 | 1041 | 60 |
| nonstructural protein NS2A | DEN 2 | gi\|158976983:3478-4131 | 508 | 1042 | 60 |
| nonstructural protein NS2A | DEN 2 | gi\|158976983:3478-4131 | 468 | 1043 | 60 |
| nonstructural protein NS2A | DEN 2 | gi\|158976983:3478-4131 | 428 | 1044 | 60 |
| nonstructural protein NS2A | DEN 2 | gi\|158976983:3478-4131 | 388 | 1045 | 60 |
| nonstructural protein NS2A | DEN 2 | gi\|158976983:3478-4131 | 346 | 1046 | 60 |
| nonstructural protein NS2A | DEN 2 | gi\|158976983:3478-4131 | 306 | 1047 | 60 |
| nonstructural protein NS2A | DEN 2 | gi\|158976983:3478-4131 | 266 | 1048 | 60 |
| nonstructural protein NS2A | DEN 2 | gi\|158976983:3478-4131 | 219 | 1049 | 60 |
| nonstructural protein NS2A | DEN 2 | gi\|158976983:3478-4131 | 119 | 1050 | 60 |
| nonstructural protein NS2B | DEN 2 | gi\|158976983:4132-4521 | 328 | 1051 | 60 |
| nonstructural protein NS2B | DEN 2 | gi\|158976983:4132-4521 | 327 | 1052 | 60 |
| nonstructural protein NS2B | DEN 2 | gi\|158976983:4132-4521 | 326 | 1053 | 60 |
| nonstructural protein NS2B | DEN 2 | gi\|158976983:4132-4521 | 325 | 1054 | 60 |
| nonstructural protein NS2B | DEN 2 | gi\|158976983:4132-4521 | 324 | 1055 | 60 |
| nonstructural protein NS2B | DEN 2 | gi\|158976983:4132-4521 | 306 | 1056 | 60 |
| nonstructural protein NS2B | DEN 2 | gi\|158976983:4132-4521 | 298 | 1057 | 60 |
| nonstructural protein NS2B | DEN 2 | gi\|158976983:4132-4521 | 297 | 1058 | 60 |
| nonstructural protein NS2B | DEN 2 | gi\|158976983:4132-4521 | 296 | 1059 | 60 |
| nonstructural protein NS2B | DEN 2 | gi\|158976983:4132-4521 | 295 | 1060 | 60 |
| nonstructural protein NS3 | DEN 2 | gi\|158976983:4522-6375 | 1795 | 1061 | 60 |
| nonstructural protein NS3 | DEN 2 | gi\|158976983:4522-6375 | 1735 | 1062 | 60 |

TABLE 1-continued

Selected viral probes

| | | | | | |
|---|---|---|---|---|---|
| nonstructural protein NS3 | DEN 2 | gi\|158976983:4522-6375 | 1675 | 1063 | 60 |
| nonstructural protein NS3 | DEN 2 | gi\|158976983:4522-6375 | 1590 | 1064 | 60 |
| nonstructural protein NS3 | DEN 2 | gi\|158976983:4522-6375 | 1509 | 1065 | 60 |
| nonstructural protein NS3 | DEN 2 | gi\|158976983:4522-6375 | 1449 | 1066 | 60 |
| nonstructural protein NS3 | DEN 2 | gi\|158976983:4522-6375 | 1389 | 1067 | 60 |
| nonstructural protein NS3 | DEN 2 | gi\|158976983:4522-6375 | 1246 | 1068 | 60 |
| nonstructural protein NS3 | DEN 2 | gi\|158976983:4522-6375 | 1186 | 1069 | 60 |
| nonstructural protein NS3 | DEN 2 | gi\|158976983:4522-6375 | 1126 | 1070 | 60 |
| nonstructural protein NS4A | DEN 2 | gi\|158976983:6376-6756 | 312 | 1071 | 60 |
| nonstructural protein NS4A | DEN 2 | gi\|158976983:6376-6756 | 311 | 1072 | 60 |
| nonstructural protein NS4A | DEN 2 | gi\|158976983:6376-6756 | 310 | 1073 | 60 |
| nonstructural protein NS4A | DEN 2 | gi\|158976983:6376-6756 | 309 | 1074 | 60 |
| nonstructural protein NS4A | DEN 2 | gi\|158976983:6376-6756 | 308 | 1075 | 60 |
| nonstructural protein NS4A | DEN 2 | gi\|158976983:6376-6756 | 307 | 1076 | 60 |
| nonstructural protein NS4A | DEN 2 | gi\|158976983:6376-6756 | 306 | 1077 | 60 |
| nonstructural protein NS4A | DEN 2 | gi\|158976983:6376-6756 | 305 | 1078 | 60 |
| nonstructural protein NS4A | DEN 2 | gi\|158976983:6376-6756 | 304 | 1079 | 60 |
| nonstructural protein NS4A | DEN 2 | gi\|158976983:6376-6756 | 303 | 1080 | 60 |
| nonstructural protein NS4B | DEN 2 | gi\|158976983:6826-7569 | 682 | 1081 | 60 |
| nonstructural protein NS4B | DEN 2 | gi\|158976983:6826-7569 | 632 | 1082 | 60 |
| nonstructural protein NS4B | DEN 2 | gi\|158976983:6826-7569 | 532 | 1083 | 60 |
| nonstructural protein NS4B | DEN 2 | gi\|158976983:6826-7569 | 491 | 1084 | 60 |
| nonstructural protein NS4B | DEN 2 | gi\|158976983:6826-7569 | 451 | 1085 | 60 |
| nonstructural protein NS4B | DEN 2 | gi\|158976983:6826-7569 | 332 | 1086 | 60 |
| nonstructural protein NS4B | DEN 2 | gi\|158976983:6826-7569 | 287 | 1087 | 60 |
| nonstructural protein NS4B | DEN 2 | gi\|158976983:6826-7569 | 168 | 1088 | 60 |
| nonstructural protein NS4B | DEN 2 | gi\|158976983:6826-7569 | 128 | 1089 | 60 |
| nonstructural protein NS4B | DEN 2 | gi\|158976983:6826-7569 | 6 | 1090 | 60 |
| RNA-dependent RNA pol. NS5 | DEN 2 | gi\|158976983:7570-10269 | 2641 | 1091 | 60 |
| RNA-dependent RNA pol. NS5 | DEN 2 | gi\|158976983:7570-10269 | 2581 | 1092 | 60 |
| RNA-dependent RNA pol. NS5 | DEN 2 | gi\|158976983:7570-10269 | 2505 | 1093 | 60 |
| RNA-dependent RNA pol. NS5 | DEN 2 | gi\|158976983:7570-10269 | 2440 | 1094 | 60 |
| RNA-dependent RNA pol. NS5 | DEN 2 | gi\|158976983:7570-10269 | 2379 | 1095 | 60 |
| RNA-dependent RNA pol. NS5 | DEN 2 | gi\|158976983:7570-10269 | 2152 | 1096 | 60 |
| RNA-dependent RNA pol. NS5 | DEN 2 | gi\|158976983:7570-10269 | 2092 | 1097 | 60 |

TABLE 1-continued

| Selected viral probes | | | | | |
|---|---|---|---|---|---|
| RNA-dependent RNA pol. NS5 | DEN 2 | gi\|158976983:7570-10269 | 2032 | 1098 | 60 |
| RNA-dependent RNA pol. NS5 | DEN 2 | gi\|158976983:7570-10269 | 1969 | 1099 | 60 |
| RNA-dependent RNA pol. NS5 | DEN 2 | gi\|158976983:7570-10269 | 1894 | 1100 | 60 |
| anchored capsid protein C | DEN 3 | gi\|163644368:95-436 | 283 | 1101 | 60 |
| anchored capsid protein C | DEN 3 | gi\|163644368:95-436 | 282 | 1102 | 60 |
| anchored capsid protein C | DEN 3 | gi\|163644368:95-436 | 281 | 1103 | 60 |
| anchored capsid protein C | DEN 3 | gi\|163644368:95-436 | 280 | 1104 | 60 |
| anchored capsid protein C | DEN 3 | gi\|163644368:95-436 | 279 | 1105 | 60 |
| anchored capsid protein C | DEN 3 | gi\|163644368:95-436 | 278 | 1106 | 60 |
| anchored capsid protein C | DEN 3 | gi\|163644368:95-436 | 277 | 1107 | 60 |
| anchored capsid protein C | DEN 3 | gi\|163644368:95-436 | 276 | 1108 | 60 |
| anchored capsid protein C | DEN 3 | gi\|163644368:95-436 | 275 | 1109 | 60 |
| anchored capsid protein C | DEN 3 | gi\|163644368:95-436 | 274 | 1110 | 60 |
| membrane glycoprotein precursor M | DEN 3 | gi\|163644368:437-934 | 439 | 1111 | 60 |
| membrane glycoprotein precursor M | DEN 3 | gi\|163644368:437-934 | 438 | 1112 | 60 |
| membrane glycoprotein precursor M | DEN 3 | gi\|163644368:437-934 | 437 | 1113 | 60 |
| membrane glycoprotein precursor M | DEN 3 | gi\|163644368:437-934 | 436 | 1114 | 60 |
| membrane glycoprotein precursor M | DEN 3 | gi\|163644368:437-934 | 435 | 1115 | 60 |
| membrane glycoprotein precursor M | DEN 3 | gi\|163644368:437-934 | 434 | 1116 | 60 |
| membrane glycoprotein precursor M | DEN 3 | gi\|163644368:437-934 | 432 | 1117 | 60 |
| membrane glycoprotein precursor M | DEN 3 | gi\|163644368:437-934 | 431 | 1118 | 60 |
| membrane glycoprotein precursor M | DEN 3 | gi\|163644368:437-934 | 430 | 1119 | 60 |
| membrane glycoprotein precursor M | DEN 3 | gi\|163644368:437-934 | 429 | 1120 | 60 |
| envelope protein E | DEN 3 | gi\|163644368:935-2413 | 1420 | 1121 | 60 |
| envelope protein E | DEN 3 | gi\|163644368:935-2413 | 1359 | 1122 | 60 |
| envelope protein E | DEN 3 | gi\|163644368:935-2413 | 1296 | 1123 | 60 |
| envelope protein E | DEN 3 | gi\|163644368:935-2413 | 1137 | 1124 | 60 |
| envelope protein E | DEN 3 | gi\|163644368:935-2413 | 1077 | 1125 | 60 |
| envelope protein E | DEN 3 | gi\|163644368:935-2413 | 994 | 1126 | 60 |
| envelope protein E | DEN 3 | gi\|163644368:935-2413 | 926 | 1127 | 60 |
| envelope protein E | DEN 3 | gi\|163644368:935-2413 | 866 | 1128 | 60 |

TABLE 1-continued

| Selected viral probes | | | | | |
|---|---|---|---|---|---|
| envelope protein E | DEN 3 | gi\|163644368:935-2413 | 805 | 1129 | 60 |
| envelope protein E | DEN 3 | gi\|163644368:935-2413 | 719 | 1130 | 60 |
| nonstructural protein NS1 | DEN 3 | gi\|163644368:2414-3469 | 997 | 1131 | 60 |
| nonstructural protein NS1 | DEN 3 | gi\|163644368:2414-3469 | 879 | 1132 | 60 |
| nonstructural protein NS1 | DEN 3 | gi\|163644368:2414-3469 | 816 | 1133 | 60 |
| nonstructural protein NS1 | DEN 3 | gi\|163644368:2414-3469 | 711 | 1134 | 60 |
| nonstructural protein NS1 | DEN 3 | gi\|163644368:2414-3469 | 651 | 1135 | 60 |
| nonstructural protein NS1 | DEN 3 | gi\|163644368:2414-3469 | 591 | 1136 | 60 |
| nonstructural protein NS1 | DEN 3 | gi\|163644368:2414-3469 | 492 | 1137 | 60 |
| nonstructural protein NS1 | DEN 3 | gi\|163644368:2414-3469 | 380 | 1138 | 60 |
| nonstructural protein NS1 | DEN 3 | gi\|163644368:2414-3469 | 320 | 1139 | 60 |
| nonstructural protein NS1 | DEN 3 | gi\|163644368:2414-3469 | 256 | 1140 | 60 |
| nonstructural protein NS2A | DEN 3 | gi\|163644368:3470-4123 | 592 | 1141 | 60 |
| nonstructural protein NS2A | DEN 3 | gi\|163644368:3470-4123 | 511 | 1142 | 60 |
| nonstructural protein NS2A | DEN 3 | gi\|163644368:3470-4123 | 463 | 1143 | 60 |
| nonstructural protein NS2A | DEN 3 | gi\|163644368:3470-4123 | 423 | 1144 | 60 |
| nonstructural protein NS2A | DEN 3 | gi\|163644368:3470-4123 | 383 | 1145 | 60 |
| nonstructural protein NS2A | DEN 3 | gi\|163644368:3470-4123 | 301 | 1146 | 60 |
| nonstructural protein NS2A | DEN 3 | gi\|163644368:3470-4123 | 260 | 1147 | 60 |
| nonstructural protein NS2A | DEN 3 | gi\|163644368:3470-4123 | 220 | 1148 | 60 |
| nonstructural protein NS2A | DEN 3 | gi\|163644368:3470-4123 | 117 | 1149 | 60 |
| nonstructural protein NS2A | DEN 3 | gi\|163644368:3470-4123 | 76 | 1150 | 60 |
| nonstructural protein NS2B | DEN 3 | gi\|163644368:4124-4513 | 325 | 1151 | 60 |
| nonstructural protein NS2B | DEN 3 | gi\|163644368:4124-4513 | 324 | 1152 | 60 |
| nonstructural protein NS2B | DEN 3 | gi\|163644368:4124-4513 | 323 | 1153 | 60 |
| nonstructural protein NS2B | DEN 3 | gi\|163644368:4124-4513 | 322 | 1154 | 60 |
| nonstructural protein NS2B | DEN 3 | gi\|163644368:4124-4513 | 321 | 1155 | 60 |
| nonstructural protein NS2B | DEN 3 | gi\|163644368:4124-4513 | 319 | 1156 | 60 |
| nonstructural protein NS2B | DEN 3 | gi\|163644368:4124-4513 | 318 | 1157 | 60 |
| nonstructural protein NS2B | DEN 3 | gi\|163644368:4124-4513 | 317 | 1158 | 60 |
| nonstructural protein NS2B | DEN 3 | gi\|163644368:4124-4513 | 313 | 1159 | 60 |
| nonstructural protein NS2B | DEN 3 | gi\|163644368:4124-4513 | 312 | 1160 | 60 |
| nonstructural protein NS3 | DEN 3 | gi\|163644368:4514-6370 | 1767 | 1161 | 60 |
| nonstructural protein NS3 | DEN 3 | gi\|163644368:4514-6370 | 1698 | 1162 | 60 |
| nonstructural protein NS3 | DEN 3 | gi\|163644368:4514-6370 | 1638 | 1163 | 60 |
| nonstructural protein NS3 | DEN 3 | gi\|163644368:4514-6370 | 1493 | 1164 | 60 |
| nonstructural protein NS3 | DEN 3 | gi\|163644368:4514-6370 | 1402 | 1165 | 60 |
| nonstructural protein NS3 | DEN 3 | gi\|163644368:4514-6370 | 1260 | 1166 | 60 |
| nonstructural protein NS3 | DEN 3 | gi\|163644368:4514-6370 | 1200 | 1167 | 60 |

TABLE 1-continued

| Selected viral probes | | | | | |
|---|---|---|---|---|---|
| nonstructural protein NS3 | DEN 3 | gi\|163644368:4514-6370 | 1137 | 1168 | 60 |
| nonstructural protein NS3 | DEN 3 | gi\|163644368:4514-6370 | 1077 | 1169 | 60 |
| nonstructural protein NS3 | DEN 3 | gi\|163644368:4514-6370 | 1016 | 1170 | 60 |
| nonstructural protein NS4A | DEN 3 | gi\|163644368:6371-6751 | 322 | 1171 | 60 |
| nonstructural protein NS4A | DEN 3 | gi\|163644368:6371-6751 | 321 | 1172 | 60 |
| nonstructural protein NS4A | DEN 3 | gi\|163644368:6371-6751 | 320 | 1173 | 60 |
| nonstructural protein NS4A | DEN 3 | gi\|163644368:6371-6751 | 319 | 1174 | 60 |
| nonstructural protein NS4A | DEN 3 | gi\|163644368:6371-6751 | 318 | 1175 | 60 |
| nonstructural protein NS4A | DEN 3 | gi\|163644368:6371-6751 | 317 | 1176 | 60 |
| nonstructural protein NS4A | DEN 3 | gi\|163644368:6371-6751 | 316 | 1177 | 60 |
| nonstructural protein NS4A | DEN 3 | gi\|163644368:6371-6751 | 315 | 1178 | 60 |
| nonstructural protein NS4A | DEN 3 | gi\|163644368:6371-6751 | 314 | 1179 | 60 |
| nonstructural protein NS4A | DEN 3 | gi\|163644368:6371-6751 | 313 | 1180 | 60 |
| nonstructural protein NS4B | DEN 3 | gi\|163644368:6821-7564 | 685 | 1181 | 60 |
| nonstructural protein NS4B | DEN 3 | gi\|163644368:6821-7564 | 621 | 1182 | 60 |
| nonstructural protein NS4B | DEN 3 | gi\|163644368:6821-7564 | 559 | 1183 | 60 |
| nonstructural protein NS4B | DEN 3 | gi\|163644368:6821-7564 | 492 | 1184 | 60 |
| nonstructural protein NS4B | DEN 3 | gi\|163644368:6821-7564 | 426 | 1185 | 60 |
| nonstructural protein NS4B | DEN 3 | gi\|163644368:6821-7564 | 350 | 1186 | 60 |
| nonstructural protein NS4B | DEN 3 | gi\|163644368:6821-7564 | 290 | 1187 | 60 |
| nonstructural protein NS4B | DEN 3 | gi\|163644368:6821-7564 | 208 | 1188 | 60 |
| nonstructural protein NS4B | DEN 3 | gi\|163644368:6821-7564 | 148 | 1189 | 60 |
| nonstructural protein NS4B | DEN 3 | gi\|163644368:6821-7564 | 37 | 1190 | 60 |
| nonstructural protein NS5 | DEN 3 | gi\|163644368:7565-10264 | 2626 | 1191 | 60 |
| nonstructural protein NS5 | DEN 3 | gi\|163644368:7565-10264 | 2516 | 1192 | 60 |
| nonstructural protein NS5 | DEN 3 | gi\|163644368:7565-10264 | 2456 | 1193 | 60 |
| nonstructural protein NS5 | DEN 3 | gi\|163644368:7565-10264 | 2390 | 1194 | 60 |
| nonstructural protein NS5 | DEN 3 | gi\|163644368:7565-10264 | 2300 | 1195 | 60 |
| nonstructural protein NS5 | DEN 3 | gi\|163644368:7565-10264 | 2198 | 1196 | 60 |
| nonstructural protein NS5 | DEN 3 | gi\|163644368:7565-10264 | 2137 | 1197 | 60 |
| nonstructural protein NS5 | DEN 3 | gi\|163644368:7565-10264 | 2048 | 1198 | 60 |
| nonstructural protein NS5 | DEN 3 | gi\|163644368:7565-10264 | 1963 | 1199 | 60 |
| nonstructural protein NS5 | DEN 4 | gi\|163644368:7565-10264 | 1903 | 1200 | 60 |
| anchored capsid protein C | DEN 4 | gi\|12084822:102-440 | 278 | 1201 | 60 |
| anchored capsid protein C | DEN 4 | gi\|12084822:102-440 | 277 | 1202 | 60 |
| anchored capsid protein C | DEN 4 | gi\|12084822:102-440 | 276 | 1203 | 60 |
| anchored capsid protein C | DEN 4 | gi\|12084822:102-440 | 275 | 1204 | 60 |
| anchored capsid protein C | DEN 4 | gi\|12084822:102-440 | 274 | 1205 | 60 |
| anchored capsid protein C | DEN 4 | gi\|12084822:102-440 | 273 | 1206 | 60 |

TABLE 1-continued

| Selected viral probes | | | | | |
|---|---|---|---|---|---|
| anchored capsid protein C | DEN 4 | gi\|12084822:102-440 | 272 | 1207 | 60 |
| anchored capsid protein C | DEN 4 | gi\|12084822:102-440 | 271 | 1208 | 60 |
| anchored capsid protein C | DEN 4 | gi\|12084822:102-440 | 270 | 1209 | 60 |
| anchored capsid protein C | DEN 4 | gi\|12084822:102-440 | 269 | 1210 | 60 |
| membrane glycoprotein precursor M | DEN 4 | gi\|12084822:441-938 | 422 | 1211 | 60 |
| membrane glycoprotein precursor M | DEN 4 | gi\|12084822:441-938 | 402 | 1212 | 60 |
| membrane glycoprotein precursor M | DEN 4 | gi\|12084822:441-938 | 380 | 1213 | 60 |
| membrane glycoprotein precursor M | DEN 4 | gi\|12084822:441-938 | 281 | 1214 | 60 |
| membrane glycoprotein precursor M | DEN 4 | gi\|12084822:441-938 | 259 | 1215 | 60 |
| membrane glycoprotein precursor M | DEN 4 | gi\|12084822:441-938 | 140 | 1216 | 60 |
| membrane glycoprotein precursor M | DEN 4 | gi\|12084822:441-938 | 96 | 1217 | 60 |
| membrane glycoprotein precursor M | DEN 4 | gi\|12084822:441-938 | 73 | 1218 | 60 |
| membrane glycoprotein precursor M | DEN 4 | gi\|12084822:441-938 | 50 | 1219 | 60 |
| membrane glycoprotein precursor M | DEN 4 | gi\|12084822:441-938 | 26 | 1220 | 60 |
| envelope protein E | DEN 4 | gi\|12084822:939-2423 | 1405 | 1221 | 60 |
| envelope protein E | DEN 4 | gi\|12084822:939-2423 | 1345 | 1222 | 60 |
| envelope protein E | DEN 4 | gi\|12084822:939-2423 | 1285 | 1223 | 60 |
| envelope protein E | DEN 4 | gi\|12084822:939-2423 | 1216 | 1224 | 60 |
| envelope protein E | DEN 4 | gi\|12084822:939-2423 | 1156 | 1225 | 60 |
| envelope protein E | DEN 4 | gi\|12084822:939-2423 | 1096 | 1226 | 60 |
| envelope protein E | DEN 4 | gi\|12084822:939-2423 | 1026 | 1227 | 60 |
| envelope protein E | DEN 4 | gi\|12084822:939-2423 | 966 | 1228 | 60 |
| envelope protein E | DEN 4 | gi\|12084822:939-2423 | 906 | 1229 | 60 |
| envelope protein E | DEN 4 | gi\|12084822:939-2423 | 846 | 1230 | 60 |
| non-structural protein NS1 | DEN 4 | gi\|12084822:2424-3479 | 993 | 1231 | 60 |
| non-structural protein NS1 | DEN 4 | gi\|12084822:2424-3479 | 823 | 1232 | 60 |
| non-structural protein NS1 | DEN 4 | gi\|12084822:2424-3479 | 710 | 1233 | 60 |
| non-structural protein NS1 | DEN 4 | gi\|12084822:2424-3479 | 638 | 1234 | 60 |
| non-structural protein NS1 | DEN 4 | gi\|12084822:2424-3479 | 570 | 1235 | 60 |
| non-structural protein NS1 | DEN 4 | gi\|12084822:2424-3479 | 510 | 1236 | 60 |
| non-structural protein NS1 | DEN 4 | gi\|12084822:2424-3479 | 450 | 1237 | 60 |
| non-structural protein NS1 | DEN 4 | gi\|12084822:2424-3479 | 390 | 1238 | 60 |
| non-structural protein NS1 | DEN 4 | gi\|12084822:2424-3479 | 330 | 1239 | 60 |
| non-structural protein NS1 | DEN 4 | gi\|12084822:2424-3479 | 209 | 1240 | 60 |

TABLE 1-continued

| | | Selected viral probes | | | |
|---|---|---|---|---|---|
| non-structural protein NS2A | DEN 4 | gi\|12084822:3480-4133 | 576 | 1241 | 60 |
| non-structural protein NS2A | DEN 4 | gi\|12084822:3480-4133 | 536 | 1242 | 60 |
| non-structural protein NS2A | DEN 4 | gi\|12084822:3480-4133 | 496 | 1243 | 60 |
| non-structural protein NS2A | DEN 4 | gi\|12084822:3480-4133 | 456 | 1244 | 60 |
| non-structural protein NS2A | DEN 4 | gi\|12084822:3480-4133 | 416 | 1245 | 60 |
| non-structural protein NS2A | DEN 4 | gi\|12084822:3480-4133 | 376 | 1246 | 60 |
| non-structural protein NS2A | DEN 4 | gi\|12084822:3480-4133 | 336 | 1247 | 60 |
| non-structural protein NS2A | DEN 4 | gi\|12084822:3480-4133 | 296 | 1248 | 60 |
| non-structural protein NS2A | DEN 4 | gi\|12084822:3480-4133 | 256 | 1249 | 60 |
| non-structural protein NS2A | DEN 4 | gi\|12084822:3480-4133 | 90 | 1250 | 60 |
| non-structural protein NS2B | DEN 4 | gi\|12084822:4134-4523 | 331 | 1251 | 60 |
| non-structural protein NS2B | DEN 4 | gi\|12084822:4134-4523 | 330 | 1252 | 60 |
| non-structural protein NS2B | DEN 4 | gi\|12084822:4134-4523 | 329 | 1253 | 60 |
| non-structural protein NS2B | DEN 4 | gi\|12084822:4134-4523 | 328 | 1254 | 60 |
| non-structural protein NS2B | DEN 4 | gi\|12084822:4134-4523 | 327 | 1255 | 60 |
| non-structural protein NS2B | DEN 4 | gi\|12084822:4134-4523 | 326 | 1256 | 60 |
| non-structural protein NS2B | DEN 4 | gi\|12084822:4134-4523 | 325 | 1257 | 60 |
| non-structural protein NS2B | DEN 4 | gi\|12084822:4134-4523 | 324 | 1258 | 60 |
| non-structural protein NS2B | DEN 4 | gi\|12084822:4134-4523 | 323 | 1259 | 60 |
| non-structural protein NS2B | DEN 4 | gi\|12084822:4134-4523 | 311 | 1260 | 60 |
| non-structural protein NS3 | DEN 4 | gi\|12084822:4524-6377 | 1780 | 1261 | 60 |
| non-structural protein NS3 | DEN 4 | gi\|12084822:4524-6377 | 1679 | 1262 | 60 |
| non-structural protein NS3 | DEN 4 | gi\|12084822:4524-6377 | 1591 | 1263 | 60 |
| non-structural protein NS3 | DEN 4 | gi\|12084822:4524-6377 | 1513 | 1264 | 60 |
| non-structural protein NS3 | DEN 4 | gi\|12084822:4524-6377 | 1442 | 1265 | 60 |
| non-structural protein NS3 | DEN 4 | gi\|12084822:4524-6377 | 1210 | 1266 | 60 |
| non-structural protein NS3 | DEN 4 | gi\|12084822:4524-6377 | 1150 | 1267 | 60 |
| non-structural protein NS3 | DEN 4 | gi\|12084822:4524-6377 | 1088 | 1268 | 60 |
| non-structural protein NS3 | DEN 4 | gi\|12084822:4524-6377 | 1027 | 1269 | 60 |
| non-structural protein NS3 | DEN 4 | gi\|12084822:4524-6377 | 840 | 1270 | 60 |
| non-structural protein NS4A | DEN 4 | gi\|12084822:6378-6758 | 322 | 1271 | 60 |
| non-structural protein NS4A | DEN 4 | gi\|12084822:6378-6758 | 321 | 1272 | 60 |
| non-structural protein NS4A | DEN 4 | gi\|12084822:6378-6758 | 320 | 1273 | 60 |
| non-structural protein NS4A | DEN 4 | gi\|12084822:6378-6758 | 319 | 1274 | 60 |
| non-structural protein NS4A | DEN 4 | gi\|12084822:6378-6758 | 318 | 1275 | 60 |
| non-structural protein NS4A | DEN 4 | gi\|12084822:6378-6758 | 317 | 1276 | 60 |
| non-structural protein NS4A | DEN 4 | gi\|12084822:6378-6758 | 316 | 1277 | 60 |
| non-structural protein NS4A | DEN 4 | gi\|12084822:6378-6758 | 315 | 1278 | 60 |
| non-structural protein NS4A | DEN 4 | gi\|12084822:6378-6758 | 314 | 1279 | 60 |

TABLE 1-continued

| Selected viral probes | | | | | |
|---|---|---|---|---|---|
| non-structural protein NS4A | DEN 4 | gi\|12084822:6378-6758 | 313 | 1280 | 60 |
| non-structural protein NS4B | DEN 4 | gi\|12084822:6828-7562 | 657 | 1281 | 60 |
| non-structural protein NS4B | DEN 4 | gi\|12084822:6828-7562 | 536 | 1282 | 60 |
| non-structural protein NS4B | DEN 4 | gi\|12084822:6828-7562 | 506 | 1283 | 60 |
| non-structural protein NS4B | DEN 4 | gi\|12084822:6828-7562 | 475 | 1284 | 60 |
| non-structural protein NS4B | DEN 4 | gi\|12084822:6828-7562 | 445 | 1285 | 60 |
| non-structural protein NS4B | DEN 4 | gi\|12084822:6828-7562 | 414 | 1286 | 60 |
| non-structural protein NS4B | DEN 4 | gi\|12084822:6828-7562 | 326 | 1287 | 60 |
| non-structural protein NS4B | DEN 4 | gi\|12084822:6828-7562 | 296 | 1288 | 60 |
| non-structural protein NS4B | DEN 4 | gi\|12084822:6828-7562 | 37 | 1289 | 60 |
| non-structural protein NS4B | DEN 4 | gi\|12084822:6828-7562 | 7 | 1290 | 60 |
| non-structural protein NS5 | DEN 4 | gi\|12084822:7563-10262 | 2641 | 1291 | 60 |
| non-structural protein NS5 | DEN 4 | gi\|12084822:7563-10262 | 2510 | 1292 | 60 |
| non-structural protein NS5 | DEN 4 | gi\|12084822:7563-10262 | 2450 | 1293 | 60 |
| non-structural protein NS5 | DEN 4 | gi\|12084822:7563-10262 | 2379 | 1294 | 60 |
| non-structural protein NS5 | DEN 4 | gi\|12084822:7563-10262 | 2153 | 1295 | 60 |
| non-structural protein NS5 | DEN 4 | gi\|12084822:7563-10262 | 2093 | 1296 | 60 |
| non-structural protein NS5 | DEN 4 | gi\|12084822:7563-10262 | 1925 | 1297 | 60 |
| non-structural protein NS5 | DEN 4 | gi\|12084822:7563-10262 | 1865 | 1298 | 60 |
| non-structural protein NS5 | DEN 4 | gi\|12084822:7563-10262 | 1805 | 1299 | 60 |
| non-structural protein NS5 | DEN 4 | gi\|12084822:7563-10262 | 1702 | 1300 | 60 |
| polyprotein precursor | GB virus C/ Hepatitis G | gi\|9628705:459-9080 | 8205 | 1301 | 60 |
| polyprotein precursor | GB virus C/ Hepatitis G | gi\|9628705:459-9080 | 7786 | 1302 | 60 |
| polyprotein precursor | GB virus C/ Hepatitis G | gi\|9628705:459-9080 | 7305 | 1303 | 60 |
| polyprotein precursor | GB virus C/ Hepatitis G | gi\|9628705:459-9080 | 7004 | 1304 | 60 |
| polyprotein precursor | GB virus C/ Hepatitis G | gi\|9628705:459-9080 | 6890 | 1305 | 60 |
| polyprotein precursor | GB virus C/ Hepatitis G | gi\|9628705:459-9080 | 6638 | 1306 | 60 |
| polyprotein precursor | GB virus C/ Hepatitis G | gi\|9628705:459-9080 | 5864 | 1307 | 60 |
| polyprotein precursor | GB virus C/ Hepatitis G | gi\|9628705:459-9080 | 5551 | 1308 | 60 |
| polyprotein precursor | GB virus C/ Hepatitis G | gi\|9628705:459-9080 | 5488 | 1309 | 60 |
| polyprotein precursor | GB virus C/ Hepatitis G | gi\|9628705:459-9080 | 3943 | 1310 | 60 |
| putative E1 protein | GB virus C/ Hepatitis G | gi\|9628705:459-1538 | 545 | 1311 | 60 |
| putative E1 protein | GB virus C/ Hepatitis G | gi\|9628705:459-1538 | 1021 | 1312 | 60 |
| putative E1 protein | GB virus C/ Hepatitis G | gi\|9628705:459-1538 | 964 | 1313 | 60 |
| putative E1 protein | GB virus C/ Hepatitis G | gi\|9628705:459-1538 | 924 | 1314 | 60 |
| putative E1 protein | GB virus C/ Hepatitis G | gi\|9628705:459-1538 | 879 | 1315 | 60 |
| putative E1 protein | GB virus C/ Hepatitis G | gi\|9628705:459-1538 | 783 | 1316 | 60 |
| putative E1 protein | GB virus C/ Hepatitis G | gi\|9628705:459-1538 | 737 | 1317 | 60 |
| putative E1 protein | GB virus C/ Hepatitis G | gi\|9628705:459-1538 | 644 | 1318 | 60 |

TABLE 1-continued

| Selected viral probes | | | | | |
|---|---|---|---|---|---|
| putative E1 protein | GB virus C/ Hepatitis G | gi|9628705:459-1538 | 601 | 1319 | 60 |
| putative E1 protein | GB virus C/ Hepatitis G | gi|9628705:459-1538 | 505 | 1320 | 60 |
| putative E2 protein | GB virus C/ Hepatitis G | gi|9628705:1539-2474 | 877 | 1321 | 60 |
| putative E2 protein | GB virus C/ Hepatitis G | gi|9628705:1539-2474 | 847 | 1322 | 60 |
| putative E2 protein | GB virus C/ Hepatitis G | gi|9628705:1539-2474 | 817 | 1323 | 60 |
| putative E2 protein | GB virus C/ Hepatitis G | gi|9628705:1539-2474 | 671 | 1324 | 60 |
| putative E2 protein | GB virus C/ Hepatitis G | gi|9628705:1539-2474 | 641 | 1325 | 60 |
| putative E2 protein | GB virus C/ Hepatitis G | gi|9628705:1539-2474 | 611 | 1326 | 60 |
| putative E2 protein | GB virus C/ Hepatitis G | gi|9628705:1539-2474 | 573 | 1327 | 60 |
| putative E2 protein | GB virus C/ Hepatitis G | gi|9628705:1539-2474 | 543 | 1328 | 60 |
| putative E2 protein | GB virus C/ Hepatitis G | gi|9628705:1539-2474 | 502 | 1329 | 60 |
| putative E2 protein | GB virus C/ Hepatitis G | gi|9628705:1539-2474 | 310 | 1330 | 60 |
| putative protein p7-NS2 | GB virus C/ Hepatitis G | gi|9628705:2475-3233 | 700 | 1331 | 60 |
| putative protein p7-NS2 | GB virus C/ Hepatitis G | gi|9628705:2475-3233 | 594 | 1332 | 60 |
| putative protein p7-NS2 | GB virus C/ Hepatitis G | gi|9628705:2475-3233 | 564 | 1333 | 60 |
| putative protein p7-NS2 | GB virus C/ Hepatitis G | gi|9628705:2475-3233 | 532 | 1334 | 60 |
| putative protein p7-NS2 | GB virus C/ Hepatitis G | gi|9628705:2475-3233 | 502 | 1335 | 60 |
| putative protein p7-NS2 | GB virus C/ Hepatitis G | gi|9628705:2475-3233 | 472 | 1336 | 60 |
| putative protein p7-NS2 | GB virus C/ Hepatitis G | gi|9628705:2475-3233 | 350 | 1337 | 60 |
| putative protein p7-NS2 | GB virus C/ Hepatitis G | gi|9628705:2475-3233 | 320 | 1338 | 60 |
| putative protein p7-NS2 | GB virus C/ Hepatitis G | gi|9628705:2475-3233 | 286 | 1339 | 60 |
| putative protein p7-NS2 | GB virus C/ Hepatitis G | gi|9628705:2475-3233 | 194 | 1340 | 60 |
| NS3 proteinase/ ATPase/helicase | GB virus C/ Hepatitis G | gi|9628705:3234-5111 | 1168 | 1341 | 60 |
| NS3 proteinase/ ATPase/helicase | GB virus C/ Hepatitis G | gi|9628705:3234-5111 | 1162 | 1342 | 60 |
| NS3 proteinase/ ATPase/helicase | GB virus C/ Hepatitis G | gi|9628705:3234-5111 | 1156 | 1343 | 60 |
| NS3 proteinase/ ATPase/helicase | GB virus C/ Hepatitis G | gi|9628705:3234-5111 | 1155 | 1344 | 60 |
| NS3 proteinase/ ATPase/helicase | GB virus C/ Hepatitis G | gi|9628705:3234-5111 | 1154 | 1345 | 60 |
| NS3 proteinase/ ATPase/helicase | GB virus C/ Hepatitis G | gi|9628705:3234-5111 | 1153 | 1346 | 60 |
| NS3 proteinase/ ATPase/helicase | GB virus C/ Hepatitis G | gi|9628705:3234-5111 | 1152 | 1347 | 60 |
| NS3 proteinase/ ATPase/helicase | GB virus C/ Hepatitis G | gi|9628705:3234-5111 | 1146 | 1348 | 60 |
| NS3 proteinase/ ATPase/helicase | GB virus C/ Hepatitis G | gi|9628705:3234-5111 | 1145 | 1349 | 60 |
| NS3 proteinase/ ATPase/helicase | GB virus C/ Hepatitis G | gi|9628705:3234-5111 | 1144 | 1350 | 60 |
| putative NS4A protein | GB virus C/ Hepatitis G | gi|9628705:5112-5309 | 45 | 1351 | 60 |
| putative NS4A protein | GB virus C/ Hepatitis G | gi|9628705:5112-5309 | 44 | 1352 | 60 |

TABLE 1-continued

| Selected viral probes | | | | | |
|---|---|---|---|---|---|
| putative NS4A protein | GB virus C/ Hepatitis G | gi\|9628705:5112-5309 | 43 | 1353 | 60 |
| putative NS4A protein | GB virus C/ Hepatitis G | gi\|9628705:5112-5309 | 42 | 1354 | 60 |
| putative NS4A protein | GB virus C/ Hepatitis G | gi\|9628705:5112-5309 | 16 | 1355 | 60 |
| putative NS4A protein | GB virus C/ Hepatitis G | gi\|9628705:5112-5309 | 13 | 1356 | 60 |
| putative NS4A protein | GB virus C/ Hepatitis G | gi\|9628705:5112-5309 | 12 | 1357 | 60 |
| putative NS4A protein | GB virus C/ Hepatitis G | gi\|9628705:5112-5309 | 11 | 1358 | 60 |
| putative NS4A protein | GB virus C/ Hepatitis G | gi\|9628705:5112-5309 | 6 | 1359 | 60 |
| putative NS4A protein | GB virus C/ Hepatitis G | gi\|9628705:5112-5309 | 5 | 1360 | 60 |
| putative NS4B protein | GB virus C/ Hepatitis G | gi\|9628705:5310-6152 | 700 | 1361 | 60 |
| putative NS4B protein | GB virus C/ Hepatitis G | gi\|9628705:5310-6152 | 699 | 1362 | 60 |
| putative NS4B protein | GB virus C/ Hepatitis G | gi\|9628705:5310-6152 | 698 | 1363 | 60 |
| putative NS4B protein | GB virus C/ Hepatitis G | gi\|9628705:5310-6152 | 696 | 1364 | 60 |
| putative NS4B protein | GB virus C/ Hepatitis G | gi\|9628705:5310-6152 | 695 | 1365 | 60 |
| putative NS4B protein | GB virus C/ Hepatitis G | gi\|9628705:5310-6152 | 694 | 1366 | 60 |
| putative NS4B protein | GB virus C/ Hepatitis G | gi\|9628705:5310-6152 | 693 | 1367 | 60 |
| putative NS4B protein | GB virus C/ Hepatitis G | gi\|9628705:5310-6152 | 692 | 1368 | 60 |
| putative NS4B protein | GB virus C/ Hepatitis G | gi\|9628705:5310-6152 | 691 | 1369 | 60 |
| putative NS4B protein | GB virus C/ Hepatitis G | gi\|9628705:5310-6152 | 690 | 1370 | 60 |
| putative NS5A protein | GB virus C/ Hepatitis G | gi\|9628705:6153-7388 | 1174 | 1371 | 60 |
| putative NS5A protein | GB virus C/ Hepatitis G | gi\|9628705:6153-7388 | 1173 | 1372 | 60 |
| putative NS5A protein | GB virus C/ Hepatitis G | gi\|9628705:6153-7388 | 1155 | 1373 | 60 |
| putative NS5A protein | GB virus C/ Hepatitis G | gi\|9628705:6153-7388 | 1154 | 1374 | 60 |
| putative NS5A protein | GB virus C/ Hepatitis G | gi\|9628705:6153-7388 | 1153 | 1375 | 60 |
| putative NS5A protein | GB virus C/ Hepatitis G | gi\|9628705:6153-7388 | 944 | 1376 | 60 |
| putative NS5A protein | GB virus C/ Hepatitis G | gi\|9628705:6153-7388 | 941 | 1377 | 60 |
| putative NS5A protein | GB virus C/ Hepatitis G | gi\|9628705:6153-7388 | 940 | 1378 | 60 |
| putative NS5A protein | GB virus C/ Hepatitis G | gi\|9628705:6153-7388 | 939 | 1379 | 60 |
| putative NS5A protein | GB virus C/ Hepatitis G | gi\|9628705:6153-7388 | 936 | 1380 | 60 |
| putative NS5B RNA-dependent RNA pol. | GB virus C/ Hepatitis G | gi\|9628705:7389-9077 | 1275 | 1381 | 60 |
| putative NS5B RNA-dependent RNA pol. | GB virus C/ Hepatitis G | gi\|9628705:7389-9077 | 1274 | 1382 | 60 |
| putative NS5B RNA-dependent RNA pol. | GB virus C/ Hepatitis G | gi\|9628705:7389-9077 | 856 | 1383 | 60 |
| putative NS5B RNA-dependent RNA pol. | GB virus C/ Hepatitis G | gi\|9628705:7389-9077 | 375 | 1384 | 60 |
| putative NS5B RNA-dependent RNA pol. | GB virus C/ Hepatitis G | gi\|9628705:7389-9077 | 374 | 1385 | 60 |

TABLE 1-continued

| Selected viral probes | | | | | |
|---|---|---|---|---|---|
| putative NS5B RNA-dependent RNA pol. | GB virus C/ Hepatitis G | gi\|9628705:7389-9077 | 373 | 1386 | 60 |
| putative NS5B RNA-dependent RNA pol. | GB virus C/ Hepatitis G | gi\|9628705:7389-9077 | 372 | 1387 | 60 |
| putative NS5B RNA-dependent RNA pol. | GB virus C/ Hepatitis G | gi\|9628705:7389-9077 | 371 | 1388 | 60 |
| putative NS5B RNA-dependent RNA pol. | GB virus C/ Hepatitis G | gi\|9628705:7389-9077 | 74 | 1389 | 60 |
| putative NS5B RNA-dependent RNA pol. | GB virus C/ Hepatitis G | gi\|9628705:7389-9077 | 73 | 1390 | 60 |
| 1A VP4b mature peptide | Hepatitis A virus | gi\|9626732:1-805 | 738 | 1391 | 60 |
| 1A VP4b mature peptide | Hepatitis A virus | gi\|9626732:1-805 | 691 | 1392 | 60 |
| 1A VP4b mature peptide | Hepatitis A virus | gi\|9626732:1-805 | 568 | 1393 | 60 |
| 1A VP4b mature peptide | Hepatitis A virus | gi\|9626732:1-805 | 513 | 1394 | 60 |
| 1A VP4b mature peptide | Hepatitis A virus | gi\|9626732:1-805 | 466 | 1395 | 60 |
| 1A VP4b mature peptide | Hepatitis A virus | gi\|9626732:1-805 | 426 | 1396 | 60 |
| 1A VP4b mature peptide | Hepatitis A virus | gi\|9626732:1-805 | 378 | 1397 | 60 |
| 1A VP4b mature peptide | Hepatitis A virus | gi\|9626732:1-805 | 338 | 1398 | 60 |
| 1A VP4b mature peptide | Hepatitis A virus | gi\|9626732:1-805 | 286 | 1399 | 60 |
| 1A VP4b mature peptide | Hepatitis A virus | gi\|9626732:1-805 | 159 | 1400 | 60 |
| 1B VP2 mature peptide | Hepatitis A virus | gi\|9626732:804-1469 | 606 | 1401 | 60 |
| 1B VP2 mature peptide | Hepatitis A virus | gi\|9626732:804-1469 | 546 | 1402 | 60 |
| 1B VP2 mature peptide | Hepatitis A virus | gi\|9626732:804-1469 | 486 | 1403 | 60 |
| 1B VP2 mature peptide | Hepatitis A virus | gi\|9626732:804-1469 | 397 | 1404 | 60 |
| 1B VP2 mature peptide | Hepatitis A virus | gi\|9626732:804-1469 | 329 | 1405 | 60 |
| 1B VP2 mature peptide | Hepatitis A virus | gi\|9626732:804-1469 | 269 | 1406 | 60 |
| 1B VP2 mature peptide | Hepatitis A virus | gi\|9626732:804-1469 | 203 | 1407 | 60 |
| 1B VP2 mature peptide | Hepatitis A virus | gi\|9626732:804-1469 | 143 | 1408 | 60 |
| 1B VP2 mature peptide | Hepatitis A virus | gi\|9626732:804-1469 | 82 | 1409 | 60 |
| 1B VP2 mature peptide | Hepatitis A virus | gi\|9626732:804-1469 | 22 | 1410 | 60 |
| 1C VP3 mature peptide | Hepatitis A virus | gi\|9626732:1470-2207 | 679 | 1411 | 60 |
| 1C VP3 mature peptide | Hepatitis A virus | gi\|9626732:1470-2207 | 619 | 1412 | 60 |
| 1C VP3 mature peptide | Hepatitis A virus | gi\|9626732:1470-2207 | 559 | 1413 | 60 |
| 1C VP3 mature peptide | Hepatitis A virus | gi\|9626732:1470-2207 | 499 | 1414 | 60 |
| 1C VP3 mature peptide | Hepatitis A virus | gi\|9626732:1470-2207 | 439 | 1415 | 60 |
| 1C VP3 mature peptide | Hepatitis A virus | gi\|9626732:1470-2207 | 379 | 1416 | 60 |
| 1C VP3 mature peptide | Hepatitis A virus | gi\|9626732:1470-2207 | 316 | 1417 | 60 |
| 1C VP3 mature peptide | Hepatitis A virus | gi\|9626732:1470-2207 | 246 | 1418 | 60 |
| 1C VP3 mature peptide | Hepatitis A virus | gi\|9626732:1470-2207 | 185 | 1419 | 60 |

TABLE 1-continued

| Selected viral probes | | | | | |
|---|---|---|---|---|---|
| 1C VP3 mature peptide | Hepatitis A virus | gi\|9626732:1470-2207 | 125 | 1420 | 60 |
| 1D VP1 mature peptide | Hepatitis A virus | gi\|9626732:2208-3107 | 841 | 1421 | 60 |
| 1D VP1 mature peptide | Hepatitis A virus | gi\|9626732:2208-3107 | 781 | 1422 | 60 |
| 1D VP1 mature peptide | Hepatitis A virus | gi\|9626732:2208-3107 | 654 | 1423 | 60 |
| 1D VP1 mature peptide | Hepatitis A virus | gi\|9626732:2208-3107 | 594 | 1424 | 60 |
| 1D VP1 mature peptide | Hepatitis A virus | gi\|9626732:2208-3107 | 534 | 1425 | 60 |
| 1D VP1 mature peptide | Hepatitis A virus | gi\|9626732:2208-3107 | 434 | 1426 | 60 |
| 1D VP1 mature peptide | Hepatitis A virus | gi\|9626732:2208-3107 | 374 | 1427 | 60 |
| 1D VP1 mature peptide | Hepatitis A virus | gi\|9626732:2208-3107 | 314 | 1428 | 60 |
| 1D VP1 mature peptide | Hepatitis A virus | gi\|9626732:2208-3107 | 249 | 1429 | 60 |
| 1D VP1 mature peptide | Hepatitis A virus | gi\|9626732:2208-3107 | 189 | 1430 | 60 |
| 2A mature peptide | Hepatitis A virus | gi\|9626732:3108-3674 | 494 | 1431 | 60 |
| 2A mature peptide | Hepatitis A virus | gi\|9626732:3108-3674 | 452 | 1432 | 60 |
| 2A mature peptide | Hepatitis A virus | gi\|9626732:3108-3674 | 412 | 1433 | 60 |
| 2A mature peptide | Hepatitis A virus | gi\|9626732:3108-3674 | 372 | 1434 | 60 |
| 2A mature peptide | Hepatitis A virus | gi\|9626732:3108-3674 | 281 | 1435 | 60 |
| 2A mature peptide | Hepatitis A virus | gi\|9626732:3108-3674 | 179 | 1436 | 60 |
| 2A mature peptide | Hepatitis A virus | gi\|9626732:3108-3674 | 136 | 1437 | 60 |
| 2A mature peptide | Hepatitis A virus | gi\|9626732:3108-3674 | 96 | 1438 | 60 |
| 2A mature peptide | Hepatitis A virus | gi\|9626732:3108-3674 | 56 | 1439 | 60 |
| 2A mature peptide | Hepatitis A virus | gi\|9626732:3108-3674 | 16 | 1440 | 60 |
| 2B mature peptide | Hepatitis A virus | gi\|9626732:3675-3995 | 262 | 1441 | 60 |
| 2B mature peptide | Hepatitis A virus | gi\|9626732:3675-3995 | 261 | 1442 | 60 |
| 2B mature peptide | Hepatitis A virus | gi\|9626732:3675-3995 | 260 | 1443 | 60 |
| 2B mature peptide | Hepatitis A virus | gi\|9626732:3675-3995 | 258 | 1444 | 60 |
| 2B mature peptide | Hepatitis A virus | gi\|9626732:3675-3995 | 257 | 1445 | 60 |
| 2B mature peptide | Hepatitis A virus | gi\|9626732:3675-3995 | 256 | 1446 | 60 |
| 2B mature peptide | Hepatitis A virus | gi\|9626732:3675-3995 | 255 | 1447 | 60 |
| 2B mature peptide | Hepatitis A virus | gi\|9626732:3675-3995 | 254 | 1448 | 60 |
| 2B mature peptide | Hepatitis A virus | gi\|9626732:3675-3995 | 253 | 1449 | 60 |
| 2B mature peptide | Hepatitis A virus | gi\|9626732:3675-3995 | 252 | 1450 | 60 |
| 2C mature peptide | Hepatitis A virus | gi\|9626732:3996-5000 | 946 | 1451 | 60 |
| 2C mature peptide | Hepatitis A virus | gi\|9626732:3996-5000 | 882 | 1452 | 60 |
| 2C mature peptide | Hepatitis A virus | gi\|9626732:3996-5000 | 774 | 1453 | 60 |
| 2C mature peptide | Hepatitis A virus | gi\|9626732:3996-5000 | 714 | 1454 | 60 |
| 2C mature peptide | Hepatitis A virus | gi\|9626732:3996-5000 | 654 | 1455 | 60 |
| 2C mature peptide | Hepatitis A virus | gi\|9626732:3996-5000 | 594 | 1456 | 60 |
| 2C mature peptide | Hepatitis A virus | gi\|9626732:3996-5000 | 534 | 1457 | 60 |
| 2C mature peptide | Hepatitis A virus | gi\|9626732:3996-5000 | 449 | 1458 | 60 |

TABLE 1-continued

| Selected viral probes | | | | | |
|---|---|---|---|---|---|
| 2C mature peptide | Hepatitis A virus | gi\|9626732:3996-5000 | 389 | 1459 | 60 |
| 2C mature peptide | Hepatitis A virus | gi\|9626732:3996-5000 | 327 | 1460 | 60 |
| 3A mature peptide | Hepatitis A virus | gi\|9626732:5001-5222 | 92 | 1461 | 60 |
| 3A mature peptide | Hepatitis A virus | gi\|9626732:5001-5222 | 91 | 1462 | 60 |
| 3A mature peptide | Hepatitis A virus | gi\|9626732:5001-5222 | 90 | 1463 | 60 |
| 3A mature peptide | Hepatitis A virus | gi\|9626732:5001-5222 | 83 | 1464 | 60 |
| 3A mature peptide | Hepatitis A virus | gi\|9626732:5001-5222 | 82 | 1465 | 60 |
| 3A mature peptide | Hepatitis A virus | gi\|9626732:5001-5222 | 81 | 1466 | 60 |
| 3A mature peptide | Hepatitis A virus | gi\|9626732:5001-5222 | 80 | 1467 | 60 |
| 3A mature peptide | Hepatitis A virus | gi\|9626732:5001-5222 | 79 | 1468 | 60 |
| 3A mature peptide | Hepatitis A virus | gi\|9626732:5001-5222 | 78 | 1469 | 60 |
| 3A mature peptide | Hepatitis A virus | gi\|9626732:5001-5222 | 77 | 1470 | 60 |
| 3B (VPg) mature peptide | Hepatitis A virus | gi\|9626732:5001-5291 | 232 | 1471 | 60 |
| 3B (VPg) mature peptide | Hepatitis A virus | gi\|9626732:5001-5291 | 231 | 1472 | 60 |
| 3B (VPg) mature peptide | Hepatitis A virus | gi\|9626732:5001-5291 | 230 | 1473 | 60 |
| 3B (VPg) mature peptide | Hepatitis A virus | gi\|9626732:5001-5291 | 229 | 1474 | 60 |
| 3B (VPg) mature peptide | Hepatitis A virus | gi\|9626732:5001-5291 | 228 | 1475 | 60 |
| 3B (VPg) mature peptide | Hepatitis A virus | gi\|9626732:5001-5291 | 227 | 1476 | 60 |
| 3B (VPg) mature peptide | Hepatitis A virus | gi\|9626732:5001-5291 | 226 | 1477 | 60 |
| 3B (VPg) mature peptide | Hepatitis A virus | gi\|9626732:5001-5291 | 225 | 1478 | 60 |
| 3B (VPg) mature peptide | Hepatitis A virus | gi\|9626732:5001-5291 | 224 | 1479 | 60 |
| 3B (VPg) mature peptide | Hepatitis A virus | gi\|9626732:5001-5291 | 223 | 1480 | 60 |
| 3C mature peptide | Hepatitis A virus | gi\|9626732:5292-5948 | 568 | 1481 | 60 |
| 3C mature peptide | Hepatitis A virus | gi\|9626732:5292-5948 | 528 | 1482 | 60 |
| 3C mature peptide | Hepatitis A virus | gi\|9626732:5292-5948 | 444 | 1483 | 60 |
| 3C mature peptide | Hepatitis A virus | gi\|9626732:5292-5948 | 396 | 1484 | 60 |
| 3C mature peptide | Hepatitis A virus | gi\|9626732:5292-5948 | 356 | 1485 | 60 |
| 3C mature peptide | Hepatitis A virus | gi\|9626732:5292-5948 | 313 | 1486 | 60 |
| 3C mature peptide | Hepatitis A virus | gi\|9626732:5292-5948 | 270 | 1487 | 60 |
| 3C mature peptide | Hepatitis A virus | gi\|9626732:5292-5948 | 230 | 1488 | 60 |
| 3C mature peptide | Hepatitis A virus | gi\|9626732:5292-5948 | 190 | 1489 | 60 |
| 3C mature peptide | Hepatitis A virus | gi\|9626732:5292-5948 | 111 | 1490 | 60 |
| 3D mature peptide | Hepatitis A virus | gi\|9626732:5949-7415 | 1403 | 1491 | 60 |
| 3D mature peptide | Hepatitis A virus | gi\|9626732:5949-7415 | 1293 | 1492 | 60 |
| 3D mature peptide | Hepatitis A virus | gi\|9626732:5949-7415 | 1233 | 1493 | 60 |
| 3D mature peptide | Hepatitis A virus | gi\|9626732:5949-7415 | 1173 | 1494 | 60 |
| 3D mature peptide | Hepatitis A virus | gi\|9626732:5949-7415 | 1113 | 1495 | 60 |
| 3D mature peptide | Hepatitis A virus | gi\|9626732:5949-7415 | 1009 | 1496 | 60 |
| 3D mature peptide | Hepatitis A virus | gi\|9626732:5949-7415 | 900 | 1497 | 60 |

TABLE 1-continued

| Selected viral probes | | | | | |
|---|---|---|---|---|---|
| 3D mature peptide | Hepatitis A virus | gi\|9626732:5949-7415 | 837 | 1498 | 60 |
| 3D mature peptide | Hepatitis A virus | gi\|9626732:5949-7415 | 777 | 1499 | 60 |
| 3D mature peptide | Hepatitis A virus | gi\|9626732:5949-7415 | 710 | 1500 | 60 |
| ORF 1-polyprotein | Hepatitis E virus | gi\|9626440:4-5085 | 4891 | 1501 | 60 |
| ORF 1-polyprotein | Hepatitis E virus | gi\|9626440:4-5085 | 4569 | 1502 | 60 |
| ORF 1-polyprotein | Hepatitis E virus | gi\|9626440:4-5085 | 4395 | 1503 | 60 |
| ORF 1-polyprotein | Hepatitis E virus | gi\|9626440:4-5085 | 4138 | 1504 | 60 |
| ORF 1-polyprotein | Hepatitis E virus | gi\|9626440:4-5085 | 3840 | 1505 | 60 |
| ORF 1-polyprotein | Hepatitis E virus | gi\|9626440:4-5085 | 3594 | 1506 | 60 |
| ORF 1-polyprotein | Hepatitis E virus | gi\|9626440:4-5085 | 2791 | 1507 | 60 |
| ORF 1-polyprotein | Hepatitis E virus | gi\|9626440:4-5085 | 2548 | 1508 | 60 |
| ORF 1-polyprotein | Hepatitis E virus | gi\|9626440:4-5085 | 2130 | 1509 | 60 |
| ORF 1-polyprotein | Hepatitis E virus | gi\|9626440:4-5085 | 1211 | 1510 | 60 |
| Viral methyltransferase | Hepatitis E virus | gi\|9626440:100-1057 | 15 | 1511 | 60 |
| Viral methyltransferase | Hepatitis E virus | gi\|9626440:100-1057 | 899 | 1512 | 60 |
| Viral methyltransferase | Hepatitis E virus | gi\|9626440:100-1057 | 826 | 1513 | 60 |
| Viral methyltransferase | Hepatitis E virus | gi\|9626440:100-1057 | 650 | 1514 | 60 |
| Viral methyltransferase | Hepatitis E virus | gi\|9626440:100-1057 | 590 | 1515 | 60 |
| Viral methyltransferase | Hepatitis E virus | gi\|9626440:100-1057 | 526 | 1516 | 60 |
| Viral methyltransferase | Hepatitis E virus | gi\|9626440:100-1057 | 409 | 1517 | 60 |
| Viral methyltransferase | Hepatitis E virus | gi\|9626440:100-1057 | 349 | 1518 | 60 |
| Viral methyltransferase | Hepatitis E virus | gi\|9626440:100-1057 | 190 | 1519 | 60 |
| Viral methyltransferase | Hepatitis E virus | gi\|9626440:100-1057 | 115 | 1520 | 60 |
| Peptidase C41 | Hepatitis E virus | gi\|9626440:1294-1783 | 431 | 1521 | 60 |
| Peptidase C41 | Hepatitis E virus | gi\|9626440:1294-1783 | 411 | 1522 | 60 |
| Peptidase C41 | Hepatitis E virus | gi\|9626440:1294-1783 | 391 | 1523 | 60 |
| Peptidase C41 | Hepatitis E virus | gi\|9626440:1294-1783 | 371 | 1524 | 60 |
| Peptidase C41 | Hepatitis E virus | gi\|9626440:1294-1783 | 251 | 1525 | 60 |
| Peptidase C41 | Hepatitis E virus | gi\|9626440:1294-1783 | 227 | 1526 | 60 |
| Peptidase C41 | Hepatitis E virus | gi\|9626440:1294-1783 | 207 | 1527 | 60 |
| Peptidase C41 | Hepatitis E virus | gi\|9626440:1294-1783 | 126 | 1528 | 60 |
| Peptidase C41 | Hepatitis E virus | gi\|9626440:1294-1783 | 106 | 1529 | 60 |
| Peptidase C41 | Hepatitis E virus | gi\|9626440:1294-1783 | 86 | 1530 | 60 |
| Viral helicase 1 | Hepatitis E virus | gi\|9626440:2914-3562 | 590 | 1531 | 60 |
| Viral helicase 1 | Hepatitis E virus | gi\|9626440:2914-3562 | 589 | 1532 | 60 |
| Viral helicase 1 | Hepatitis E virus | gi\|9626440:2914-3562 | 586 | 1533 | 60 |
| Viral helicase 1 | Hepatitis E virus | gi\|9626440:2914-3562 | 585 | 1534 | 60 |
| Viral helicase 1 | Hepatitis E virus | gi\|9626440:2914-3562 | 583 | 1535 | 60 |
| Viral helicase 1 | Hepatitis E virus | gi\|9626440:2914-3562 | 548 | 1536 | 60 |

TABLE 1-continued

| Selected viral probes | | | | | |
|---|---|---|---|---|---|
| Viral helicase 1 | Hepatitis E virus | gi\|9626440:2914-3562 | 547 | 1537 | 60 |
| Viral helicase 1 | Hepatitis E virus | gi\|9626440:2914-3562 | 546 | 1538 | 60 |
| Viral helicase 1 | Hepatitis E virus | gi\|9626440:2914-3562 | 544 | 1539 | 60 |
| Viral helicase 1 | Hepatitis E virus | gi\|9626440:2914-3562 | 543 | 1540 | 60 |
| RNA dependent RNA pol. | Hepatitis E virus | gi\|9626440:4191-4684 | 382 | 1541 | 60 |
| RNA dependent RNA pol. | Hepatitis E virus | gi\|9626440:4191-4684 | 381 | 1542 | 60 |
| RNA dependent RNA pol. | Hepatitis E virus | gi\|9626440:4191-4684 | 380 | 1543 | 60 |
| RNA dependent RNA pol. | Hepatitis E virus | gi\|9626440:4191-4684 | 208 | 1544 | 60 |
| RNA dependent RNA pol. | Hepatitis E virus | gi\|9626440:4191-4684 | 207 | 1545 | 60 |
| RNA dependent RNA pol. | Hepatitis E virus | gi\|9626440:4191-4684 | 205 | 1546 | 60 |
| RNA dependent RNA pol. | Hepatitis E virus | gi\|9626440:4191-4684 | 204 | 1547 | 60 |
| RNA dependent RNA pol. | Hepatitis E virus | gi\|9626440:4191-4684 | 203 | 1548 | 60 |
| RNA dependent RNA pol. | Hepatitis E virus | gi\|9626440:4191-4684 | 202 | 1549 | 60 |
| RNA dependent RNA pol. | Hepatitis E virus | gi\|9626440:4191-4684 | 201 | 1550 | 60 |
| ORF 3-hypothetical protein | Hepatitis E virus | gi\|9626440:5109-5453 | 135 | 1551 | 60 |
| ORF 3-hypothetical protein | Hepatitis E virus | gi\|9626440:5109-5453 | 134 | 1552 | 60 |
| ORF 3-hypothetical protein | Hepatitis E virus | gi\|9626440:5109-5453 | 133 | 1553 | 60 |
| ORF 3-hypothetical protein | Hepatitis E virus | gi\|9626440:5109-5453 | 132 | 1554 | 60 |
| ORF 3-hypothetical protein | Hepatitis E virus | gi\|9626440:5109-5453 | 131 | 1555 | 60 |
| ORF 3-hypothetical protein | Hepatitis E virus | gi\|9626440:5109-5453 | 130 | 1556 | 60 |
| ORF 3-hypothetical protein | Hepatitis E virus | gi\|9626440:5109-5453 | 129 | 1557 | 60 |
| ORF 3-hypothetical protein | Hepatitis E virus | gi\|9626440:5109-5453 | 142 | 1558 | 60 |
| ORF 3-hypothetical protein | Hepatitis E virus | gi\|9626440:5109-5453 | 141 | 1559 | 60 |
| ORF 3-hypothetical protein | Hepatitis E virus | gi\|9626440:5109-5453 | 140 | 1560 | 60 |
| ORF 2-capsid protein | Hepatitis E virus | gi\|9626440:5123-7105 | 1661 | 1561 | 60 |
| ORF 2-capsid protein | Hepatitis E virus | gi\|9626440:5123-7105 | 1660 | 1562 | 60 |
| ORF 2-capsid protein | Hepatitis E virus | gi\|9626440:5123-7105 | 1659 | 1563 | 60 |
| ORF 2-capsid protein | Hepatitis E virus | gi\|9626440:5123-7105 | 1658 | 1564 | 60 |
| ORF 2-capsid protein | Hepatitis E virus | gi\|9626440:5123-7105 | 1657 | 1565 | 60 |
| ORF 2-capsid protein | Hepatitis E virus | gi\|9626440:5123-7105 | 1656 | 1566 | 60 |
| ORF 2-capsid protein | Hepatitis E virus | gi\|9626440:5123-7105 | 1655 | 1567 | 60 |
| ORF 2-capsid protein | Hepatitis E virus | gi\|9626440:5123-7105 | 1654 | 1568 | 60 |
| ORF 2-capsid protein | Hepatitis E virus | gi\|9626440:5123-7105 | 1653 | 1569 | 60 |
| ORF 2-capsid protein | Hepatitis E virus | gi\|9626440:5123-7105 | 1652 | 1570 | 60 |

TABLE 1-continued

| Selected viral probes | | | | | |
|---|---|---|---|---|---|
| RNA dependent RNA pol. | WCCV1 RNA1 | gi\|52220883:75-1925 | 1783 | 1571 | 60 |
| RNA dependent RNA pol. | WCCV1 RNA1 | gi\|52220883:75-1925 | 1722 | 1572 | 60 |
| RNA dependent RNA pol. | WCCV1 RNA1 | gi\|52220883:75-1925 | 1638 | 1573 | 60 |
| RNA dependent RNA pol. | WCCV1 RNA1 | gi\|52220883:75-1925 | 1410 | 1574 | 60 |
| RNA dependent RNA pol. | WCCV1 RNA1 | gi\|52220883:75-1925 | 1350 | 1575 | 60 |
| RNA dependent RNA pol. | WCCV1 RNA1 | gi\|52220883:75-1925 | 1290 | 1576 | 60 |
| RNA dependent RNA pol. | WCCV1 RNA1 | gi\|52220883:75-1925 | 1230 | 1577 | 60 |
| RNA dependent RNA pol. | WCCV1 RNA1 | gi\|52220883:75-1925 | 1170 | 1578 | 60 |
| RNA dependent RNA pol. | WCCV1 RNA1 | gi\|52220883:75-1925 | 1087 | 1579 | 60 |
| RNA dependent RNA pol. | WCCV1 RNA1 | gi\|52220883:75-1925 | 999 | 1580 | 60 |
| Putative protease cofactor | BBWV 1 RNA 1 | gi\|39163640:201-1154 | 875 | 1581 | 60 |
| putative protease cofactor | BBWV 1 RNA 1 | gi\|39163640:201-1154 | 815 | 1582 | 60 |
| putative protease cofactor | BBWV 1 RNA 1 | gi\|39163640:201-1154 | 731 | 1583 | 60 |
| putative protease cofactor | BBWV 1 RNA 1 | gi\|39163640:201-1154 | 671 | 1584 | 60 |
| putative protease cofactor | BBWV 1 RNA 1 | gi\|39163640:201-1154 | 609 | 1585 | 60 |
| putative protease cofactor | BBWV 1 RNA 1 | gi\|39163640:201-1154 | 546 | 1586 | 60 |
| putative protease cofactor | BBWV 1 RNA 1 | gi\|39163640:201-1154 | 479 | 1587 | 60 |
| putative protease cofactor | BBWV 1 RNA 1 | gi\|39163640:201-1154 | 419 | 1588 | 60 |
| putative protease cofactor | BBWV 1 RNA 1 | gi\|39163640:201-1154 | 330 | 1589 | 60 |
| putative protease cofactor | BBWV 1 RNA 1 | gi\|39163640:201-1154 | 252 | 1590 | 60 |
| NTP-binding protein | BBWV 1 RNA 1 | gi\|39163640:1155-2924 | 1694 | 1591 | 60 |
| NTP-binding protein | BBWV 1 RNA 1 | gi\|39163640:1155-2924 | 1623 | 1592 | 60 |
| NTP-binding protein | BBWV 1 RNA 1 | gi\|39163640:1155-2924 | 1553 | 1593 | 60 |
| NTP-binding protein | BBWV 1 RNA 1 | gi\|39163640:1155-2924 | 1493 | 1594 | 60 |
| NTP-binding protein | BBWV 1 RNA 1 | gi\|39163640:1155-2924 | 1431 | 1595 | 60 |
| NTP-binding protein | BBWV 1 RNA 1 | gi\|39163640:1155-2924 | 1371 | 1596 | 60 |
| NTP-binding protein | BBWV 1 RNA 1 | gi\|39163640:1155-2924 | 1310 | 1597 | 60 |
| NTP-binding protein | BBWV 1 RNA 1 | gi\|39163640:1155-2924 | 1250 | 1598 | 60 |
| NTP-binding protein | BBWV 1 RNA 1 | gi\|39163640:1155-2924 | 1113 | 1599 | 60 |
| NTP-binding protein | BBWV 1 RNA 1 | gi\|39163640:1155-2924 | 1053 | 1600 | 60 |
| cysteine protease | BBWV 1 RNA 1 | gi\|39163640:3003-3629 | 512 | 1601 | 60 |
| cysteine protease | BBWV 1 RNA 1 | gi\|39163640:3003-3629 | 466 | 1602 | 60 |
| cysteine protease | BBWV 1 RNA 1 | gi\|39163640:3003-3629 | 426 | 1603 | 60 |
| cysteine protease | BBWV 1 RNA 1 | gi\|39163640:3003-3629 | 335 | 1604 | 60 |

TABLE 1-continued

| Selected viral probes | | | | | |
|---|---|---|---|---|---|
| cysteine protease | BBWV 1 RNA 1 | gi\|39163640:3003-3629 | 295 | 1605 | 60 |
| cysteine protease | BBWV 1 RNA 1 | gi\|39163640:3003-3629 | 251 | 1606 | 60 |
| cysteine protease | BBWV 1 RNA 1 | gi\|39163640:3003-3629 | 211 | 1607 | 60 |
| cysteine protease | BBWV 1 RNA 1 | gi\|39163640:3003-3629 | 171 | 1608 | 60 |
| cysteine protease | BBWV 1 RNA 1 | gi\|39163640:3003-3629 | 131 | 1609 | 60 |
| cysteine protease | BBWV 1 RNA 1 | gi\|39163640:3003-3629 | 91 | 1610 | 60 |
| RNA-dependent RNA pol. | BBWV 1 RNA 1 | gi\|39163640:3630-5726 | 2038 | 1611 | 60 |
| RNA-dependent RNA pol. | BBWV 1 RNA 1 | gi\|39163640:3630-5726 | 1978 | 1612 | 60 |
| RNA-dependent RNA pol. | BBWV 1 RNA 1 | gi\|39163640:3630-5726 | 1918 | 1613 | 60 |
| RNA-dependent RNA pol. | BBWV 1 RNA 1 | gi\|39163640:3630-5726 | 1858 | 1614 | 60 |
| RNA-dependent RNA pol. | BBWV 1 RNA 1 | gi\|39163640:3630-5726 | 1798 | 1615 | 60 |
| RNA-dependent RNA pol. | BBWV 1 RNA 1 | gi\|39163640:3630-5726 | 1738 | 1616 | 60 |
| RNA-dependent RNA pol. | BBWV 1 RNA 1 | gi\|39163640:3630-5726 | 1678 | 1617 | 60 |
| RNA-dependent RNA pol. | BBWV 1 RNA 1 | gi\|39163640:3630-5726 | 1588 | 1618 | 60 |
| RNA-dependent RNA pol. | BBWV 1 RNA 1 | gi\|39163640:3630-5726 | 1525 | 1619 | 60 |
| RNA-dependent RNA pol. | BBWV 1 RNA 1 | gi\|39163640:3630-5726 | 1362 | 1620 | 60 |
| nucleocapsid protein | LNYV | gi\|83659771:1-1623 | 1525 | 1621 | 60 |
| nucleocapsid protein | LNYV | gi\|83659771:1-1623 | 1465 | 1622 | 60 |
| nucleocapsid protein | LNYV | gi\|83659771:1-1623 | 1398 | 1623 | 60 |
| nucleocapsid protein | LNYV | gi\|83659771:1-1623 | 1313 | 1624 | 60 |
| nucleocapsid protein | LNYV | gi\|83659771:1-1623 | 1253 | 1625 | 60 |
| nucleocapsid protein | LNYV | gi\|83659771:1-1623 | 1193 | 1626 | 60 |
| nucleocapsid protein | LNYV | gi\|83659771:1-1623 | 1125 | 1627 | 60 |
| nucleocapsid protein | LNYV | gi\|83659771:1-1623 | 1065 | 1628 | 60 |
| nucleocapsid protein | LNYV | gi\|83659771:1-1623 | 989 | 1629 | 60 |
| nucleocapsid protein | LNYV | gi\|83659771:1-1623 | 901 | 1630 | 60 |
| phospoprotein | LNYV | gi\|83659771:1631-2712 | 993 | 1631 | 60 |
| phospoprotein | LNYV | gi\|83659771:1631-2712 | 933 | 1632 | 60 |
| phospoprotein | LNYV | gi\|83659771:1631-2712 | 873 | 1633 | 60 |
| phospoprotein | LNYV | gi\|83659771:1631-2712 | 738 | 1634 | 60 |
| phospoprotein | LNYV | gi\|83659771:1631-2712 | 652 | 1635 | 60 |
| phospoprotein | LNYV | gi\|83659771:1631-2712 | 559 | 1636 | 60 |
| phospoprotein | LNYV | gi\|83659771:1631-2712 | 491 | 1637 | 60 |
| phospoprotein | LNYV | gi\|83659771:1631-2712 | 431 | 1638 | 60 |
| phospoprotein | LNYV | gi\|83659771:1631-2712 | 371 | 1639 | 60 |
| phospoprotein | LNYV | gi\|83659771:1631-2712 | 311 | 1640 | 60 |
| gene"4b | LNYV | gi\|83659771:2720-3765 | 987 | 1641 | 60 |
| gene"4b | LNYV | gi\|83659771:2720-3765 | 927 | 1642 | 60 |
| gene"4b | LNYV | gi\|83659771:2720-3765 | 867 | 1643 | 60 |
| gene"4b | LNYV | gi\|83659771:2720-3765 | 794 | 1644 | 60 |
| gene"4b | LNYV | gi\|83659771:2720-3765 | 734 | 1645 | 60 |
| gene"4b | LNYV | gi\|83659771:2720-3765 | 674 | 1646 | 60 |

TABLE 1-continued

| Selected viral probes | | | | | |
|---|---|---|---|---|---|
| gene"4b | LNYV | gi\|83659771:2720-3765 | 613 | 1647 | 60 |
| gene"4b | LNYV | gi\|83659771:2720-3765 | 553 | 1648 | 60 |
| gene"4b | LNYV | gi\|83659771:2720-3765 | 491 | 1649 | 60 |
| gene"4b | LNYV | gi\|83659771:2720-3765 | 431 | 1650 | 60 |
| matrix protein | LNYV | gi\|83659771:3773-4403 | 554 | 1651 | 60 |
| matrix protein | LNYV | gi\|83659771:3773-4403 | 514 | 1652 | 60 |
| matrix protein | LNYV | gi\|83659771:3773-4403 | 438 | 1653 | 60 |
| matrix protein | LNYV | gi\|83659771:3773-4403 | 391 | 1654 | 60 |
| matrix protein | LNYV | gi\|83659771:3773-4403 | 351 | 1655 | 60 |
| matrix protein | LNYV | gi\|83659771:3773-4403 | 308 | 1656 | 60 |
| matrix protein | LNYV | gi\|83659771:3773-4403 | 244 | 1657 | 60 |
| matrix protein | LNYV | gi\|83659771:3773-4403 | 203 | 1658 | 60 |
| matrix protein | LNYV | gi\|83659771:3773-4403 | 163 | 1659 | 60 |
| matrix protein | LNYV | gi\|83659771:3773-4403 | 51 | 1660 | 60 |
| gene G | LNYV | gi\|83659771:4412-6247 | 1777 | 1661 | 60 |
| gene G | LNYV | gi\|83659771:4412-6247 | 1717 | 1662 | 60 |
| gene G | LNYV | gi\|83659771:4412-6247 | 1657 | 1663 | 60 |
| gene G | LNYV | gi\|83659771:4412-6247 | 1597 | 1664 | 60 |
| gene G | LNYV | gi\|83659771:4412-6247 | 1531 | 1665 | 60 |
| gene G | LNYV | gi\|83659771:4412-6247 | 1448 | 1666 | 60 |
| gene G | LNYV | gi\|83659771:4412-6247 | 1365 | 1667 | 60 |
| gene G | LNYV | gi\|83659771:4412-6247 | 1236 | 1668 | 60 |
| gene G | LNYV | gi\|83659771:4412-6247 | 1160 | 1669 | 60 |
| gene G | LNYV | gi\|83659771:4412-6247 | 1100 | 1670 | 60 |
| RNA-dependent RNA pol. | LNYV | gi\|83659771:6278-12613 | 6101 | 1671 | 60 |
| RNA-dependent RNA pol. | LNYV | gi\|83659771:6278-12613 | 6041 | 1672 | 60 |
| RNA-dependent RNA pol. | LNYV | gi\|83659771:6278-12613 | 5949 | 1673 | 60 |
| RNA-dependent RNA pol. | LNYV | gi\|83659771:6278-12613 | 5887 | 1674 | 60 |
| RNA-dependent RNA pol. | LNYV | gi\|83659771:6278-12613 | 5827 | 1675 | 60 |
| RNA-dependent RNA pol. | LNYV | gi\|83659771:6278-12613 | 5767 | 1676 | 60 |
| RNA-dependent RNA pol. | LNYV | gi\|83659771:6278-12613 | 5707 | 1677 | 60 |
| RNA-dependent RNA pol. | LNYV | gi\|83659771:6278-12613 | 5573 | 1678 | 60 |
| RNA-dependent RNA pol. | LNYV | gi\|83659771:6278-12613 | 5513 | 1679 | 60 |
| RNA-dependent RNA pol. | LNYV | gi\|83659771:6278-12613 | 5423 | 1680 | 60 |
| 5' trailer RNA | LNYV | gi\|83659771:12621-12807 | 128 | 1681 | 60 |
| 5' trailer RNA | LNYV | gi\|83659771:12621-12807 | 127 | 1682 | 60 |
| 5' trailer RNA | LNYV | gi\|83659771:12621-12807 | 126 | 1683 | 60 |
| 5' trailer RNA | LNYV | gi\|83659771:12621-12807 | 125 | 1684 | 60 |
| 5' trailer RNA | LNYV | gi\|83659771:12621-12807 | 124 | 1685 | 60 |
| 5' trailer RNA | LNYV | gi\|83659771:12621-12807 | 123 | 1686 | 60 |
| 5' trailer RNA | LNYV | gi\|83659771:12621-12807 | 115 | 1687 | 60 |
| 5' trailer RNA | LNYV | gi\|83659771:12621-12807 | 114 | 1688 | 60 |
| 5' trailer RNA | LNYV | gi\|83659771:12621-12807 | 113 | 1689 | 60 |
| 5' trailer RNA | LNYV | gi\|83659771:12621-12807 | 112 | 1690 | 60 |
| NS5 protein | Zika Brazil-ZKV2015 | gi\|985578255\|gb\|KU497555.1\| | 10296 | 1691 | 60 |
| NS5 protein | Zika Brazil-ZKV2015 | gi\|985578255\|gb\|KU497555.1\| | 10235 | 1692 | 60 |
| NS5 protein | Zika Brazil-ZKV2015 | gi\|985578255\|gb\|KU497555.1\| | 10162 | 1693 | 60 |
| NS5 protein | Zika Brazil-ZKV2015 | gi\|985578255\|gb\|KU497555.1\| | 9922 | 1694 | 60 |
| NS5 protein | Zika Brazil-ZKV2015 | gi\|985578255\|gb\|KU497555.1\| | 9714 | 1695 | 60 |
| NS5 protein | Zika Brazil-ZKV2015 | gi\|985578255\|gb\|KU497555.1\| | 9654 | 1696 | 60 |
| NS5 protein | Zika Brazil-ZKV2015 | gi\|985578255\|gb\|KU497555.1\| | 9510 | 1697 | 60 |

TABLE 1-continued

| \multicolumn{5}{c}{Selected viral probes} | | | | |
|---|---|---|---|---|
| NS5 protein | Zika Brazil-ZKV2015 | gi\|985578255\|gb\|KU497555.1\| | 9444 | 1698 | 60 |
| NS5 protein | Zika Brazil-ZKV2015 | gi\|985578255\|gb\|KU497555.1\| | 9383 | 1699 | 60 |
| NS5 protein | Zika Brazil-ZKV2015 | gi\|985578255\|gb\|KU497555.1\| | 9288 | 1700 | 60 |
| NS5 protein | Zika PRVABC59 | gi\|984874581\|gb\|KU501215.1\| | 10340 | 1701 | 60 |
| NS5 protein | Zika PRVABC59 | gi\|984874581\|gb\|KU501215.1\| | 10277 | 1702 | 60 |
| NS5 protein | Zika PRVABC59 | gi\|984874581\|gb\|KU501215.1\| | 10168 | 1703 | 60 |
| NS5 protein | Zika PRVABC59 | gi\|984874581\|gb\|KU501215.1\| | 9928 | 1704 | 60 |
| NS5 protein | Zika PRVABC59 | gi\|984874581\|gb\|KU501215.1\| | 9720 | 1705 | 60 |
| NS5 protein | Zika PRVABC59 | gi\|984874581\|gb\|KU501215.1\| | 9660 | 1706 | 60 |
| NS5 protein | Zika PRVABC59 | gi\|984874581\|gb\|KU501215.1\| | 9516 | 1707 | 60 |
| NS5 protein | Zika PRVABC59 | gi\|984874581\|gb\|KU501215.1\| | 9450 | 1708 | 60 |
| NS5 protein | Zika PRVABC59 | gi\|984874581\|gb\|KU501215.1\| | 9389 | 1709 | 60 |
| NS5 protein | Zika PRVABC59 | gi\|984874581\|gb\|KU501215.1\| | 9295 | 1710 | 60 |
| NS5 protein | Zika Z1106033 | gi\|973447404\|gb\|KU312312.1\| | 10274 | 1711 | 60 |
| NS5 protein | Zika Z1106033 | gi\|973447404\|gb\|KU312312.1\| | 10211 | 1712 | 60 |
| NS5 protein | Zika Z1106033 | gi\|973447404\|gb\|KU312312.1\| | 10102 | 1713 | 60 |
| NS5 protein | Zika Z1106033 | gi\|973447404\|gb\|KU312312.1\| | 9862 | 1714 | 60 |
| NS5 protein | Zika Z1106033 | gi\|973447404\|gb\|KU312312.1\| | 9654 | 1715 | 60 |
| NS5 protein | Zika Z1106033 | gi\|973447404\|gb\|KU312312.1\| | 9594 | 1716 | 60 |
| NS5 protein | Zika Z1106033 | gi\|973447404\|gb\|KU312312.1\| | 9450 | 1717 | 60 |
| NS5 protein | Zika Z1106033 | gi\|973447404\|gb\|KU312312.1\| | 9384 | 1718 | 60 |
| NS5 protein | Zika Z1106033 | gi\|973447404\|gb\|KU312312.1\| | 9323 | 1719 | 60 |
| NS5 protein | Zika Z1106033 | gi\|973447404\|gb\|KU312312.1\| | 9229 | 1720 | 60 |
| NS5 protein | Zika SSABR1 | gi\|992324757\|gb\|KU707826.1\| | 10274 | 1721 | 60 |
| NS5 protein | Zika SSABR1 | gi\|992324757\|gb\|KU707826.1\| | 10139 | 1722 | 60 |
| NS5 protein | Zika SSABR1 | gi\|992324757\|gb\|KU707826.1\| | 9900 | 1723 | 60 |
| NS5 protein | Zika SSABR1 | gi\|992324757\|gb\|KU707826.1\| | 9692 | 1724 | 60 |
| NS5 protein | Zika SSABR1 | gi\|992324757\|gb\|KU707826.1\| | 9632 | 1725 | 60 |
| NS5 protein | Zika SSABR1 | gi\|992324757\|gb\|KU707826.1\| | 9488 | 1726 | 60 |
| NS5 protein | Zika SSABR1 | gi\|992324757\|gb\|KU707826.1\| | 9422 | 1727 | 60 |
| NS5 protein | Zika SSABR1 | gi\|992324757\|gb\|KU707826.1\| | 9361 | 1728 | 60 |
| NS5 protein | Zika SSABR1 | gi\|992324757\|gb\|KU707826.1\| | 9296 | 1729 | 60 |
| NS5 protein | Zika SSABR1 | gi\|992324757\|gb\|KU707826.1\| | 9190 | 1730 | 60 |
| 5UTR | ZikaSPH2015 | gb\|KU321639.1\|:1-105 | 46 | 1731 | 60 |
| 5UTR | ZikaSPH2015 | gb\|KU321639.1\|:1-105 | 37 | 1732 | 60 |
| capsid | ZikaSPH2015 | gb\|KU321639.1\|:106-480 | 232 | 1733 | 60 |
| capsid | ZikaSPH2015 | gb\|KU321639.1\|:106-480 | 216 | 1734 | 60 |
| propeptide | ZikaSPH2015 | gb\|KU321639.1\|:478-750 | 100 | 1735 | 60 |
| propeptide | ZikaSPH2015 | gb\|KU321639.1\|:478-750 | 91 | 1736 | 60 |
| membrane protein | ZikaSPH2015 | gb\|KU321639.1\|:751-975 | 162 | 1737 | 60 |
| membrane protein | ZikaSPH2015 | gb\|KU321639.1\|:751-975 | 148 | 1738 | 60 |
| envelope protein | ZikaSPH2015 | gb\|KU321639.1\|:976-2490 | 1442 | 1739 | 60 |
| envelope protein | ZikaSPH2015 | gb\|KU321639.1\|:976-2490 | 1322 | 1740 | 60 |
| envelope protein | ZikaSPH2015 | gb\|KU321639.1\|:976-2490 | 1069 | 1741 | 60 |
| envelope protein | ZikaSPH2015 | gb\|KU321639.1\|:976-2490 | 556 | 1742 | 60 |
| envelope protein | ZikaSPH2015 | gb\|KU321639.1\|:976-2490 | 318 | 1743 | 60 |
| NS1 protein | ZikaSPH2015 | gb\|KU321639.1\|:2491-3576 | 1023 | 1744 | 60 |
| NS1 protein | ZikaSPH2015 | gb\|KU321639.1\|:2491-3576 | 648 | 1745 | 60 |
| NS1 protein | ZikaSPH2015 | gb\|KU321639.1\|:2491-3576 | 479 | 1746 | 60 |
| NS1 protein | ZikaSPH2015 | gb\|KU321639.1\|:2491-3576 | 221 | 1747 | 60 |
| NS2A protein | ZikaSPH2015 | gb\|KU321639.1\|:3577-4230 | 507 | 1748 | 60 |
| NS2A protein | ZikaSPH2015 | gb\|KU321639.1\|:3577-4230 | 503 | 1749 | 60 |
| NS2A protein | ZikaSPH2015 | gb\|KU321639.1\|:3577-4230 | 204 | 1750 | 60 |
| NS2B protein | ZikaSPH2015 | gb\|KU321639.1\|:4231-4662 | 146 | 1751 | 60 |
| NS2B protein | ZikaSPH2015 | gb\|KU321639.1\|:4231-4662 | 141 | 1752 | 60 |
| NS2B protein | ZikaSPH2015 | gb\|KU321639.1\|:4231-4662 | 136 | 1753 | 60 |
| NS3 protein | ZikaSPH2015 | gb\|KU321639.1\|:4663-6471 | 1618 | 1754 | 60 |
| NS3 protein | ZikaSPH2015 | gb\|KU321639.1\|:4663-6471 | 1415 | 1755 | 60 |
| NS3 protein | ZikaSPH2015 | gb\|KU321639.1\|:4663-6471 | 1013 | 1756 | 60 |
| NS3 protein | ZikaSPH2015 | gb\|KU321639.1\|:4663-6471 | 679 | 1757 | 60 |
| NS4A protein | ZikaSPH2015 | gb\|KU321639.1\|:6472-6912 | 196 | 1758 | 60 |
| NS4A protein | ZikaSPH2015 | gb\|KU321639.1\|:6472-6912 | 238 | 1759 | 60 |
| NS4A protein | ZikaSPH2015 | gb\|KU321639.1\|:6472-6912 | 59 | 1760 | 60 |
| NS4B protein | ZikaSPH2015 | gb\|KU321639.1\|:6913-8418 | 1395 | 1761 | 60 |
| NS4B protein | ZikaSPH2015 | gb\|KU321639.1\|:6913-8418 | 688 | 1762 | 60 |
| NS4B protein | ZikaSPH2015 | gb\|KU321639.1\|:6913-8418 | 425 | 1763 | 60 |
| NS4B protein | ZikaSPH2015 | gb\|KU321639.1\|:6913-8418 | 1 | 1764 | 60 |
| NS5 protein | ZikaSPH2015 | gb\|KU321639.1\|:8419-10374 | 1883 | 1765 | 60 |

TABLE 1-continued

| Selected viral probes | | | | | | | |
|---|---|---|---|---|---|---|---|
| NS5 protein | ZikaSPH2015 | gb\|KU321639.1\|:8419-10374 | 1241 | 1766 | 60 | | |
| NS5 protein | ZikaSPH2015 | gb\|KU321639.1\|:8419-10374 | 785 | 1767 | 60 | | |
| 3UTR | ZikaSPH2015 | gb\|KU321639.1\|:10378-10676 | 239 | 1768 | 60 | | |
| 3UTR | ZikaSPH2015 | gb\|KU321639.1\|:10378-10676 | 230 | 1769 | 60 | | |

| Product | End Distance | Tm | X-Hyb Pot | % G | % C | % A | % T | % GC | PolyX |
|---|---|---|---|---|---|---|---|---|---|
| 5 UTR | 99 | 85.97 | 0 | 36.67 | 18.33 | 20 | 25 | 55 | 3 |
| 5 UTR | 148 | 86.4 | 0 | 26.67 | 28.33 | 20 | 25 | 55 | 5 |
| 5 UTR | 149 | 86.4 | 0 | 25 | 30 | 20 | 25 | 55 | 5 |
| 5 UTR | 169 | 86.33 | 0 | 28.33 | 26.67 | 20 | 25 | 55 | 3 |
| 5 UTR | 170 | 85.49 | 0 | 28.33 | 25 | 21.67 | 25 | 53.33 | 3 |
| 5 UTR | 171 | 84.8 | 0 | 28.33 | 25 | 21.67 | 25 | 53.33 | 3 |
| 5 UTR | 172 | 84.8 | 0 | 28.33 | 25 | 21.67 | 25 | 53.33 | 3 |
| 5 UTR | 173 | 85.38 | 0 | 26.67 | 26.67 | 21.67 | 25 | 53.33 | 3 |
| 5 UTR | 174 | 86.09 | 0 | 26.67 | 28.33 | 21.67 | 23.33 | 55 | 3 |
| 5 UTR | 175 | 86.62 | 0 | 26.67 | 28.33 | 23.33 | 21.67 | 55 | 3 |
| core protein | 86 | 83.62 | 0 | 16.67 | 33.33 | 13.33 | 36.67 | 50 | 3 |
| core protein | 87 | 83.16 | 0 | 16.67 | 33.33 | 15 | 35 | 50 | 3 |
| core protein | 88 | 83.16 | 0 | 18.33 | 31.67 | 15 | 35 | 50 | 3 |
| core protein | 89 | 83.23 | 0 | 18.33 | 31.67 | 15 | 35 | 50 | 3 |
| core protein | 90 | 82.5 | 0 | 20 | 30 | 15 | 35 | 50 | 3 |
| core protein | 91 | 83.08 | 0 | 18.33 | 31.67 | 15 | 35 | 50 | 3 |
| core protein | 92 | 83.48 | 0 | 20 | 31.67 | 15 | 33.33 | 51.67 | 3 |
| core protein | 93 | 83.48 | 0 | 21.67 | 30 | 15 | 33.33 | 51.67 | 3 |
| core protein | 94 | 83.47 | 0 | 21.67 | 30 | 15 | 33.33 | 51.67 | 3 |
| core protein | 95 | 83.15 | 0 | 21.67 | 28.33 | 16.67 | 33.33 | 50 | 3 |
| E1 protein | 239 | 81.42 | 0 | 25 | 20 | 25 | 30 | 45 | 3 |
| E1 protein | 240 | 81.39 | 0 | 25 | 20 | 25 | 30 | 45 | 3 |
| E1 protein | 241 | 80.98 | 0 | 25 | 20 | 25 | 30 | 45 | 3 |
| E1 protein | 242 | 80.98 | 0 | 23.33 | 21.67 | 25 | 30 | 45 | 3 |
| E1 protein | 77 | 86.03 | 0 | 35 | 20 | 15 | 30 | 55 | 4 |
| E1 protein | 78 | 84.91 | 0 | 35 | 18.33 | 15 | 31.67 | 53.33 | 4 |
| E1 protein | 79 | 84.78 | 0 | 33.33 | 18.33 | 16.67 | 31.67 | 51.67 | 4 |
| E1 protein | 80 | 84.88 | 0 | 33.33 | 20 | 16.67 | 30 | 53.33 | 4 |
| E1 protein | 81 | 85.73 | 0 | 35 | 20 | 16.67 | 28.33 | 55 | 4 |
| E1 protein | 202 | 85.79 | 0 | 35 | 20 | 20 | 25 | 55 | 4 |
| E2 protein | 387 | 80.23 | 0 | 25 | 20 | 28.33 | 26.67 | 45 | 4 |
| E2 protein | 388 | 80.23 | 0 | 23.33 | 21.67 | 28.33 | 26.67 | 45 | 4 |
| E2 protein | 389 | 80.33 | 0 | 23.33 | 21.67 | 28.33 | 26.67 | 45 | 4 |
| E2 protein | 390 | 79.75 | 0 | 21.67 | 23.33 | 28.33 | 26.67 | 45 | 4 |
| E2 protein | 391 | 80.57 | 0 | 23.33 | 21.67 | 28.33 | 26.67 | 45 | 4 |
| E2 protein | 393 | 80.57 | 0 | 23.33 | 21.67 | 28.33 | 26.67 | 45 | 3 |
| E2 protein | 394 | 79.86 | 0 | 21.67 | 21.67 | 28.33 | 28.33 | 43.33 | 3 |
| E2 protein | 395 | 79.16 | 0 | 20 | 21.67 | 28.33 | 30 | 41.67 | 3 |
| E2 protein | 396 | 79.16 | 0 | 18.33 | 23.33 | 28.33 | 30 | 41.67 | 3 |
| E2 protein | 397 | 79.61 | 0 | 20 | 23.33 | 26.67 | 30 | 43.33 | 3 |
| p7 protein | 134 | 85.66 | 0 | 33.33 | 21.67 | 6.67 | 38.33 | 55 | 3 |
| p7 protein | 135 | 85.02 | 0 | 31.67 | 23.33 | 6.67 | 38.33 | 55 | 3 |
| p7 protein | 136 | 84.74 | 0 | 31.67 | 21.67 | 6.67 | 40 | 53.33 | 3 |
| p7 protein | 137 | 84.15 | 0 | 33.33 | 20 | 6.67 | 40 | 53.33 | 3 |
| p7 protein | 138 | 84.01 | 0 | 35 | 18.33 | 6.67 | 40 | 53.33 | 3 |
| p7 protein | 139 | 84.59 | 0 | 33.33 | 20 | 6.67 | 40 | 53.33 | 3 |
| p7 protein | 140 | 84.59 | 0 | 33.33 | 20 | 8.33 | 38.33 | 53.33 | 3 |
| p7 protein | 141 | 84 | 0 | 31.67 | 21.67 | 8.33 | 38.33 | 53.33 | 3 |
| p7 protein | 142 | 84.14 | 0 | 31.67 | 21.67 | 8.33 | 38.33 | 53.33 | 3 |
| p7 protein | 143 | 84.72 | 0 | 30 | 23.33 | 8.33 | 38.33 | 53.33 | 3 |
| NS2 protein | 286 | 81.87 | 0 | 23.33 | 21.67 | 26.67 | 28.33 | 45 | 4 |
| NS2 protein | 458 | 80.3 | 0 | 16.67 | 28.33 | 21.67 | 33.33 | 45 | 3 |
| NS2 protein | 459 | 79.57 | 0 | 15 | 28.33 | 23.33 | 33.33 | 43.33 | 3 |
| NS2 protein | 460 | 79.57 | 0 | 13.33 | 30 | 23.33 | 33.33 | 43.33 | 3 |
| NS2 protein | 461 | 79.55 | 0 | 13.33 | 30 | 23.33 | 33.33 | 43.33 | 3 |
| NS2 protein | 462 | 78.99 | 0 | 15 | 28.33 | 23.33 | 33.33 | 43.33 | 3 |
| NS2 protein | 463 | 79.66 | 0 | 15 | 28.33 | 23.33 | 33.33 | 43.33 | 3 |
| NS2 protein | 464 | 79.92 | 0 | 15 | 30 | 23.33 | 31.67 | 45 | 3 |
| NS2 protein | 465 | 80.63 | 0 | 16.67 | 28.33 | 23.33 | 31.67 | 45 | 3 |
| NS2 protein | 466 | 81.42 | 0 | 16.67 | 28.33 | 21.67 | 33.33 | 45 | 3 |
| NS3 protease/helicase | 82 | 81.47 | 0 | 15 | 30 | 33.33 | 21.67 | 45 | 3 |
| NS3 protease/helicase | 274 | 80.84 | 0 | 18.33 | 26.67 | 28.33 | 26.67 | 45 | 4 |
| NS3 protease/helicase | 1045 | 81.99 | 0 | 20 | 25 | 26.67 | 28.33 | 45 | 3 |
| NS3 protease/helicase | 150 | 85.74 | 0 | 18.33 | 35 | 25 | 21.67 | 53.33 | 4 |
| NS3 protease/helicase | 397 | 85.21 | 0 | 26.67 | 28.33 | 25 | 20 | 55 | 3 |

TABLE 1-continued

| Selected viral probes | | | | | | | | | |
|---|---|---|---|---|---|---|---|---|---|
| NS3 protease/helicase | 600 | 82.34 | 0 | 15 | 35 | 25 | 25 | 50 | 3 |
| NS3 protease/helicase | 660 | 83.78 | 0 | 25 | 26.67 | 20 | 28.33 | 51.67 | 3 |
| NS3 protease/helicase | 802 | 86.5 | 0 | 25 | 30 | 23.33 | 21.67 | 55 | 3 |
| NS3 protease/helicase | 874 | 85.78 | 0 | 21.67 | 33.33 | 21.67 | 23.33 | 55 | 5 |
| NS3 protease/helicase | 1129 | 85.24 | 0 | 20 | 35 | 25 | 20 | 55 | 4 |
| NS4A protein | 60 | 82.67 | 0 | 31.67 | 20 | 26.67 | 21.67 | 51.67 | 3 |
| NS4A protein | 61 | 82.67 | 0 | 33.33 | 18.33 | 26.67 | 21.67 | 51.67 | 3 |
| NS4A protein | 62 | 83 | 0 | 31.67 | 18.33 | 28.33 | 21.67 | 50 | 3 |
| NS4A protein | 63 | 82.48 | 0 | 31.67 | 18.33 | 30 | 20 | 50 | 3 |
| NS4A protein | 64 | 82.45 | 0 | 31.67 | 18.33 | 30 | 20 | 50 | 3 |
| NS4A protein | 65 | 82.74 | 0 | 33.33 | 18.33 | 28.33 | 20 | 51.67 | 3 |
| NS4A protein | 66 | 83.4 | 0 | 33.33 | 18.33 | 28.33 | 20 | 51.67 | 3 |
| NS4A protein | 67 | 84.1 | 0 | 33.33 | 20 | 26.67 | 20 | 53.33 | 3 |
| NS4A protein | 68 | 84.37 | 0 | 33.33 | 21.67 | 25 | 20 | 55 | 3 |
| NS4A protein | 69 | 84.1 | 0 | 31.67 | 21.67 | 25 | 21.67 | 53.33 | 3 |
| NS4B protein | 651 | 81.1 | 0 | 26.67 | 18.33 | 28.33 | 26.67 | 45 | 3 |
| NS4B protein | 61 | 85.12 | 0 | 26.67 | 28.33 | 23.33 | 21.67 | 55 | 3 |
| NS4B protein | 82 | 85.36 | 0 | 23.33 | 31.67 | 25 | 20 | 55 | 3 |
| NS4B protein | 328 | 85.9 | 0 | 28.33 | 26.67 | 21.67 | 23.33 | 55 | 4 |
| NS4B protein | 368 | 86.89 | 0 | 35 | 20 | 20 | 25 | 55 | 3 |
| NS4B protein | 558 | 85.23 | 0 | 16.67 | 35 | 23.33 | 25 | 51.67 | 4 |
| NS4B protein | 580 | 86.8 | 0 | 21.67 | 33.33 | 18.33 | 26.67 | 55 | 4 |
| NS4B protein | 602 | 86.58 | 0 | 25 | 30 | 18.33 | 26.67 | 55 | 4 |
| NS4B protein | 622 | 84.77 | 0 | 28.33 | 25 | 21.67 | 25 | 53.33 | 3 |
| NS4B protein | 671 | 84.31 | 0 | 26.67 | 25 | 26.67 | 21.67 | 51.67 | 3 |
| NS5A protein | 943 | 82.2 | 0 | 16.67 | 28.33 | 28.33 | 26.67 | 45 | 5 |
| NS5A protein | 207 | 85.98 | 0 | 20 | 35 | 23.33 | 21.67 | 55 | 3 |
| NS5A protein | 267 | 86.55 | 0 | 20 | 35 | 23.33 | 21.67 | 55 | 4 |
| NS5A protein | 371 | 85.27 | 0 | 26.67 | 28.33 | 26.67 | 18.33 | 55 | 5 |
| NS5A protein | 519 | 85.49 | 0 | 36.67 | 18.33 | 23.33 | 21.67 | 55 | 3 |
| NS5A protein | 767 | 85.27 | 0 | 23.33 | 31.67 | 25 | 20 | 55 | 3 |
| NS5A protein | 830 | 85.03 | 0 | 30 | 25 | 23.33 | 21.67 | 55 | 4 |
| NS5A protein | 1003 | 84.8 | 0 | 38.33 | 16.67 | 25 | 20 | 55 | 5 |
| NS5A protein | 1131 | 85.18 | 0 | 31.67 | 23.33 | 23.33 | 21.67 | 55 | 4 |
| NS5A protein | 1191 | 84.43 | 0 | 26.67 | 25 | 28.33 | 20 | 51.67 | 5 |
| NS5B RNA-dependent RNA polymerase | 214 | 81.13 | 0 | 18.33 | 26.67 | 35 | 20 | 45 | 3 |
| NS5B RNA-dependent RNA polymerase | 215 | 80 | 0 | 18.33 | 25 | 35 | 21.67 | 43.33 | 3 |
| NS5B RNA-dependent RNA polymerase | 216 | 79.91 | 0 | 16.67 | 25 | 36.67 | 21.67 | 41.67 | 3 |
| NS5B RNA-dependent RNA polymerase | 217 | 80.32 | 0 | 16.67 | 26.67 | 35 | 21.67 | 43.33 | 3 |
| NS5B RNA-dependent RNA polymerase | 218 | 81.05 | 0 | 16.67 | 28.33 | 35 | 20 | 45 | 3 |
| NS5B RNA-dependent RNA polymerase | 383 | 81.64 | 0 | 15 | 30 | 30 | 25 | 45 | 4 |
| NS5B RNA-dependent RNA polymerase | 490 | 80.87 | 0 | 21.67 | 23.33 | 23.33 | 31.67 | 45 | 3 |
| NS5B RNA-dependent RNA polymerase | 491 | 81.12 | 0 | 21.67 | 23.33 | 23.33 | 31.67 | 45 | 3 |
| NS5B RNA-dependent RNA polymerase | 542 | 81.8 | 0 | 20 | 25 | 25 | 30 | 45 | 5 |
| NS5B RNA-dependent RNA polymerase | 543 | 82.09 | 0 | 20 | 25 | 25 | 30 | 45 | 5 |
| 5 UTR | 80 | 86.27 | 0 | 36.67 | 18.33 | 20 | 25 | 55 | 3 |
| 5 UTR | 150 | 86.34 | 0 | 26.67 | 28.33 | 18.33 | 26.67 | 55 | 3 |
| 5 UTR | 151 | 85.5 | 0 | 26.67 | 26.67 | 20 | 26.67 | 53.33 | 3 |
| 5 UTR | 152 | 84.8 | 0 | 26.67 | 26.67 | 20 | 26.67 | 53.33 | 3 |
| 5 UTR | 153 | 84.8 | 0 | 26.67 | 26.67 | 20 | 26.67 | 53.33 | 3 |
| 5 UTR | 154 | 85.38 | 0 | 25 | 28.33 | 20 | 26.67 | 53.33 | 3 |
| 5 UTR | 155 | 86.1 | 0 | 25 | 30 | 20 | 25 | 55 | 3 |
| 5 UTR | 156 | 86.64 | 0 | 25 | 30 | 21.67 | 23.33 | 55 | 3 |

TABLE 1-continued

| Selected viral probes | | | | | | | | | |
|---|---|---|---|---|---|---|---|---|---|
| 5 UTR | 159 | 85.77 | 0 | 25 | 30 | 21.67 | 23.33 | 55 | 3 |
| 5 UTR | 160 | 85.03 | 0 | 26.67 | 28.33 | 21.67 | 23.33 | 55 | 3 |
| core protein | 550 | 82 | 0 | 15 | 30 | 43.33 | 11.67 | 45 | 5 |
| core protein | 551 | 81.31 | 0 | 13.33 | 30 | 45 | 11.67 | 43.33 | 5 |
| core protein | 552 | 80.33 | 0 | 11.67 | 30 | 45 | 13.33 | 41.67 | 5 |
| core protein | 553 | 79.71 | 0 | 11.67 | 30 | 45 | 13.33 | 41.67 | 5 |
| core protein | 554 | 80.36 | 0 | 11.67 | 30 | 45 | 13.33 | 41.67 | 5 |
| core protein | 555 | 80.76 | 0 | 11.67 | 30 | 45 | 13.33 | 41.67 | 5 |
| core protein | 556 | 80.73 | 0 | 11.67 | 30 | 46.67 | 11.67 | 41.67 | 5 |
| core protein | 557 | 80.23 | 0 | 11.67 | 30 | 48.33 | 10 | 41.67 | 5 |
| core protein | 558 | 80.17 | 0 | 10 | 30 | 50 | 10 | 40 | 5 |
| core protein | 573 | 80.76 | 0 | 13.33 | 30 | 46.67 | 10 | 43.33 | 5 |
| E1 protein | 84 | 85.82 | 0 | 30 | 25 | 13.33 | 31.67 | 55 | 3 |
| E1 protein | 120 | 86.52 | 0 | 31.67 | 23.33 | 15 | 30 | 55 | 4 |
| E1 protein | 140 | 85.78 | 0 | 31.67 | 23.33 | 16.67 | 28.33 | 55 | 4 |
| E1 protein | 160 | 85.1 | 0 | 30 | 25 | 18.33 | 26.67 | 55 | 4 |
| E1 protein | 217 | 86.77 | 0 | 28.33 | 26.67 | 23.33 | 21.67 | 55 | 3 |
| E1 protein | 237 | 84.8 | 0 | 26.67 | 26.67 | 25 | 21.67 | 53.33 | 3 |
| E1 protein | 257 | 85.97 | 0 | 21.67 | 33.33 | 23.33 | 21.67 | 55 | 3 |
| E1 protein | 283 | 85.94 | 0 | 20 | 35 | 18.33 | 26.67 | 55 | 3 |
| E1 protein | 303 | 86.01 | 0 | 20 | 33.33 | 21.67 | 25 | 53.33 | 3 |
| E1 protein | 555 | 85.87 | 0 | 23.33 | 31.67 | 23.33 | 21.67 | 55 | 2 |
| E2/NS1 protein | 106 | 81.03 | 0 | 15 | 30 | 30 | 25 | 45 | 4 |
| E2/NS1 protein | 107 | 81 | 0 | 15 | 28.33 | 31.67 | 25 | 43.33 | 4 |
| E2/NS1 protein | 109 | 79.92 | 0 | 13.33 | 30 | 33.33 | 23.33 | 43.33 | 4 |
| E2/NS1 protein | 110 | 80.58 | 0 | 13.33 | 30 | 33.33 | 23.33 | 43.33 | 4 |
| E2/NS1 protein | 111 | 81.11 | 0 | 13.33 | 30 | 35 | 21.67 | 43.33 | 4 |
| E2/NS1 protein | 324 | 80.66 | 0 | 28.33 | 16.67 | 30 | 25 | 45 | 4 |
| E2/NS1 protein | 325 | 80.1 | 0 | 28.33 | 16.67 | 30 | 25 | 45 | 4 |
| E2/NS1 protein | 326 | 79.81 | 0 | 26.67 | 16.67 | 31.67 | 25 | 43.33 | 4 |
| E2/NS1 protein | 327 | 79.81 | 0 | 26.67 | 16.67 | 31.67 | 25 | 43.33 | 4 |
| E2/NS1 protein | 328 | 79.81 | 0 | 26.67 | 16.67 | 31.67 | 25 | 43.33 | 4 |
| NS2 protein | 69 | 86.42 | 0 | 33.33 | 21.67 | 16.67 | 28.33 | 55 | 4 |
| NS2 protein | 109 | 83.87 | 0 | 33.33 | 20 | 23.33 | 23.33 | 53.33 | 4 |
| NS2 protein | 184 | 85.33 | 0 | 23.33 | 31.67 | 18.33 | 26.67 | 55 | 4 |
| NS2 protein | 224 | 85.13 | 0 | 28.33 | 26.67 | 21.67 | 23.33 | 55 | 3 |
| NS2 protein | 312 | 86.25 | 0 | 30 | 25 | 18.33 | 26.67 | 55 | 4 |
| NS2 protein | 354 | 86.42 | 0 | 28.33 | 26.67 | 16.67 | 28.33 | 55 | 4 |
| NS2 protein | 394 | 86.1 | 0 | 30 | 25 | 16.67 | 28.33 | 55 | 3 |
| NS2 protein | 492 | 85.79 | 0 | 36.67 | 18.33 | 13.33 | 31.67 | 55 | 5 |
| NS2 protein | 532 | 83.84 | 0 | 23.33 | 26.67 | 13.33 | 36.67 | 50 | 5 |
| NS2 protein | 572 | 85.42 | 0 | 25 | 30 | 18.33 | 26.67 | 55 | 5 |
| NS3 protease/helicase | 257 | 80.97 | 0 | 25 | 20 | 35 | 20 | 45 | 5 |
| NS3 protease/helicase | 258 | 79.98 | 0 | 23.33 | 20 | 35 | 21.67 | 43.33 | 5 |
| NS3 protease/helicase | 259 | 79.94 | 0 | 23.33 | 18.33 | 35 | 23.33 | 41.67 | 5 |
| NS3 protease/helicase | 260 | 79.58 | 0 | 23.33 | 20 | 35 | 21.67 | 43.33 | 5 |
| NS3 protease/helicase | 261 | 79.13 | 0 | 23.33 | 18.33 | 35 | 23.33 | 41.67 | 5 |
| NS3 protease/helicase | 262 | 79.21 | 0 | 23.33 | 18.33 | 35 | 23.33 | 41.67 | 5 |
| NS3 protease/helicase | 263 | 79.3 | 0 | 23.33 | 18.33 | 33.33 | 25 | 41.67 | 5 |
| NS3 protease/helicase | 264 | 78.66 | 0 | 21.67 | 20 | 33.33 | 25 | 41.67 | 5 |
| NS3 protease/helicase | 265 | 79.21 | 0 | 21.67 | 20 | 33.33 | 25 | 41.67 | 5 |
| NS3 protease/helicase | 266 | 79.51 | 0 | 21.67 | 21.67 | 31.67 | 25 | 43.33 | 5 |
| NS4A protein | 60 | 84.4 | 0 | 35 | 18.33 | 21.67 | 25 | 53.33 | 4 |
| NS4A protein | 61 | 84.4 | 0 | 36.67 | 16.67 | 21.67 | 25 | 53.33 | 4 |
| NS4A protein | 62 | 84.65 | 0 | 38.33 | 16.67 | 21.67 | 23.33 | 55 | 4 |
| NS4A protein | 63 | 84.55 | 0 | 38.33 | 16.67 | 21.67 | 23.33 | 55 | 4 |
| NS4A protein | 64 | 84.5 | 0 | 36.67 | 18.33 | 21.67 | 23.33 | 55 | 4 |
| NS4A protein | 65 | 84.65 | 0 | 36.67 | 18.33 | 21.67 | 23.33 | 55 | 4 |

TABLE 1-continued

| Selected viral probes | | | | | | | | | |
|---|---|---|---|---|---|---|---|---|---|
| NS4A protein | 66 | 84.5 | 0 | 36.67 | 18.33 | 21.67 | 23.33 | 55 | 4 |
| NS4A protein | 67 | 84.64 | 0 | 36.67 | 18.33 | 21.67 | 23.33 | 55 | 4 |
| NS4A protein | 68 | 84.45 | 0 | 35 | 18.33 | 21.67 | 25 | 53.33 | 4 |
| NS4A protein | 69 | 84.41 | 0 | 33.33 | 18.33 | 21.67 | 26.67 | 51.67 | 4 |
| NS4B protein | 498 | 81.45 | 0 | 20 | 25 | 33.33 | 21.67 | 45 | 3 |
| NS4B protein | 499 | 81.54 | 0 | 20 | 25 | 33.33 | 21.67 | 45 | 3 |
| NS4B protein | 573 | 81.76 | 0 | 16.67 | 28.33 | 36.67 | 18.33 | 45 | 3 |
| NS4B protein | 574 | 81.76 | 0 | 15 | 30 | 36.67 | 18.33 | 45 | 3 |
| NS4B protein | 578 | 82.24 | 0 | 15 | 30 | 38.33 | 16.67 | 45 | 3 |
| NS4B protein | 579 | 81.73 | 0 | 15 | 30 | 38.33 | 16.67 | 45 | 3 |
| NS4B protein | 580 | 81.06 | 0 | 16.67 | 28.33 | 38.33 | 16.67 | 45 | 3 |
| NS4B protein | 581 | 80.87 | 0 | 16.67 | 26.67 | 38.33 | 18.33 | 43.33 | 3 |
| NS4B protein | 582 | 80.8 | 0 | 16.67 | 26.67 | 38.33 | 18.33 | 43.33 | 3 |
| NS4B protein | 583 | 81.64 | 0 | 18.33 | 26.67 | 36.67 | 18.33 | 45 | 3 |
| NS5A protein | 1352 | 82.47 | 0 | 15 | 30 | 26.67 | 28.33 | 45 | 5 |
| NS5A protein | 1360 | 80.77 | 0 | 13.33 | 30 | 31.67 | 25 | 43.33 | 5 |
| NS5A protein | 1361 | 80.86 | 0 | 13.33 | 30 | 31.67 | 25 | 43.33 | 5 |
| NS5A protein | 1363 | 80.94 | 0 | 13.33 | 30 | 33.33 | 23.33 | 43.33 | 5 |
| NS5A protein | 1364 | 80.21 | 0 | 13.33 | 30 | 33.33 | 23.33 | 43.33 | 5 |
| NS5A protein | 1365 | 80.37 | 0 | 13.33 | 30 | 33.33 | 23.33 | 43.33 | 5 |
| NS5A protein | 1366 | 80.16 | 0 | 11.67 | 30 | 33.33 | 25 | 41.67 | 5 |
| NS5A protein | 1367 | 79.46 | 0 | 11.67 | 28.33 | 33.33 | 26.67 | 40 | 5 |
| NS5A protein | 1368 | 78.76 | 0 | 11.67 | 26.67 | 33.33 | 28.33 | 38.33 | 5 |
| NS5A protein | 1369 | 78.05 | 0 | 13.33 | 25 | 33.33 | 28.33 | 38.33 | 5 |
| NS5B RNA-dependent RNA polymerase | 161 | 82.16 | 0 | 16.67 | 28.33 | 26.67 | 28.33 | 45 | 5 |
| NS5B RNA-dependent RNA polymerase | 162 | 81.45 | 0 | 16.67 | 28.33 | 26.67 | 28.33 | 45 | 5 |
| NS5B RNA-dependent RNA polymerase | 163 | 81.29 | 0 | 16.67 | 26.67 | 28.33 | 28.33 | 43.33 | 5 |
| NS5B RNA-dependent RNA polymerase | 164 | 81.01 | 0 | 16.67 | 26.67 | 26.67 | 30 | 43.33 | 5 |
| NS5B RNA-dependent RNA polymerase | 165 | 80.66 | 0 | 16.67 | 28.33 | 25 | 30 | 45 | 5 |
| NS5B RNA-dependent RNA polymerase | 166 | 80.8 | 0 | 16.67 | 28.33 | 25 | 30 | 45 | 5 |
| NS5B RNA-dependent RNA polymerase | 167 | 81.11 | 0 | 16.67 | 26.67 | 26.67 | 30 | 43.33 | 5 |
| NS5B RNA-dependent RNA polymerase | 168 | 80.73 | 0 | 16.67 | 28.33 | 25 | 30 | 45 | 5 |
| NS5B RNA-dependent RNA polymerase | 169 | 80.73 | 0 | 16.67 | 28.33 | 25 | 30 | 45 | 5 |
| NS5B RNA-dependent RNA polymerase | 170 | 80.73 | 0 | 16.67 | 28.33 | 25 | 30 | 45 | 5 |
| 5 UTR | 95 | 86.03 | 0 | 35 | 20 | 16.67 | 28.33 | 55 | 3 |
| 5 UTR | 96 | 86.01 | 0 | 35 | 20 | 18.33 | 26.67 | 55 | 3 |
| 5 UTR | 98 | 85.18 | 0 | 36.67 | 18.33 | 20 | 25 | 55 | 3 |
| 5 UTR | 99 | 85.09 | 0 | 36.67 | 18.33 | 20 | 25 | 55 | 3 |
| 5 UTR | 148 | 86.22 | 0 | 23.33 | 31.67 | 23.33 | 21.67 | 55 | 5 |
| 5 UTR | 149 | 86.22 | 0 | 21.67 | 33.33 | 23.33 | 21.67 | 55 | 5 |
| 5 UTR | 170 | 86.32 | 0 | 28.33 | 26.67 | 21.67 | 23.33 | 55 | 4 |
| 5 UTR | 171 | 85.62 | 0 | 28.33 | 26.67 | 21.67 | 23.33 | 55 | 4 |
| 5 UTR | 172 | 85.62 | 0 | 28.33 | 26.67 | 21.67 | 23.33 | 55 | 4 |
| 5 UTR | 173 | 86.2 | 0 | 26.67 | 28.33 | 21.67 | 23.33 | 55 | 4 |
| Core protein | 88 | 82.34 | 0 | 16.67 | 28.33 | 15 | 40 | 45 | 4 |
| Core protein | 89 | 82.06 | 0 | 16.67 | 28.33 | 15 | 40 | 45 | 4 |
| Core protein | 90 | 81.52 | 0 | 16.67 | 28.33 | 16.67 | 38.33 | 45 | 4 |
| Core protein | 91 | 81.43 | 0 | 16.67 | 28.33 | 16.67 | 38.33 | 45 | 4 |
| Core protein | 60 | 80.8 | 0 | 11.67 | 31.67 | 11.67 | 45 | 43.33 | 4 |
| Core protein | 61 | 80.29 | 0 | 11.67 | 31.67 | 11.67 | 45 | 43.33 | 4 |
| Core protein | 62 | 80.37 | 0 | 11.67 | 31.67 | 11.67 | 45 | 43.33 | 4 |
| Core protein | 72 | 80.32 | 0 | 11.67 | 30 | 10 | 48.33 | 41.67 | 4 |
| Core protein | 73 | 80.39 | 0 | 13.33 | 30 | 10 | 46.67 | 43.33 | 4 |
| Core protein | 75 | 81.25 | 0 | 16.67 | 28.33 | 8.33 | 46.67 | 45 | 4 |
| E1 protein | 540 | 81.72 | 0 | 21.67 | 23.33 | 28.33 | 26.67 | 45 | 2 |
| E1 protein | 541 | 80.93 | 0 | 21.67 | 23.33 | 26.67 | 28.33 | 45 | 2 |
| E1 protein | 542 | 80.8 | 0 | 21.67 | 21.67 | 26.67 | 30 | 43.33 | 2 |
| E1 protein | 543 | 80.36 | 0 | 21.67 | 23.33 | 25 | 30 | 45 | 2 |

TABLE 1-continued

| Selected viral probes | | | | | | | | | |
|---|---|---|---|---|---|---|---|---|---|
| E1 protein | 544 | 80.92 | 0 | 21.67 | 23.33 | 25 | 30 | 45 | 2 |
| E1 protein | 545 | 80.83 | 0 | 21.67 | 23.33 | 23.33 | 31.67 | 45 | 2 |
| E1 protein | 546 | 80.12 | 0 | 23.33 | 21.67 | 23.33 | 31.67 | 45 | 2 |
| E1 protein | 547 | 80.69 | 0 | 21.67 | 23.33 | 23.33 | 31.67 | 45 | 2 |
| E1 protein | 548 | 80.76 | 0 | 21.67 | 23.33 | 25 | 30 | 45 | 2 |
| E1 protein | 549 | 80.44 | 0 | 21.67 | 21.67 | 25 | 31.67 | 43.33 | 2 |
| E2/NS1 protein | 132 | 81.65 | 0 | 16.67 | 28.33 | 28.33 | 26.67 | 45 | 4 |
| E2/NS1 protein | 320 | 81.74 | 0 | 31.67 | 13.33 | 20 | 35 | 45 | 3 |
| E2/NS1 protein | 321 | 81.07 | 0 | 31.67 | 13.33 | 20 | 35 | 45 | 3 |
| E2/NS1 protein | 322 | 81.08 | 0 | 31.67 | 13.33 | 20 | 35 | 45 | 3 |
| E2/NS1 protein | 323 | 80.65 | 0 | 31.67 | 11.67 | 20 | 36.67 | 43.33 | 3 |
| E2/NS1 protein | 324 | 80.08 | 0 | 31.67 | 11.67 | 20 | 36.67 | 43.33 | 3 |
| E2/NS1 protein | 325 | 79.81 | 0 | 31.67 | 10 | 21.67 | 36.67 | 41.67 | 3 |
| E2/NS1 protein | 326 | 79.81 | 0 | 31.67 | 10 | 21.67 | 36.67 | 41.67 | 3 |
| E2/NS1 protein | 327 | 80.59 | 0 | 31.67 | 10 | 21.67 | 36.67 | 41.67 | 3 |
| E2/NS1 protein | 328 | 80.31 | 0 | 31.67 | 10 | 21.67 | 36.67 | 41.67 | 3 |
| NS2 | 108 | 81.33 | 0 | 23.33 | 21.67 | 30 | 25 | 45 | 4 |
| NS2 | 122 | 81.32 | 0 | 18.33 | 26.67 | 30 | 25 | 45 | 3 |
| NS2 | 124 | 80.65 | 0 | 20 | 25 | 31.67 | 23.33 | 45 | 3 |
| NS2 | 125 | 80.51 | 0 | 20 | 23.33 | 33.33 | 23.33 | 43.33 | 3 |
| NS2 | 126 | 80 | 0 | 20 | 23.33 | 33.33 | 23.33 | 43.33 | 3 |
| NS2 | 127 | 80.1 | 0 | 20 | 23.33 | 33.33 | 23.33 | 43.33 | 3 |
| NS2 | 128 | 80.54 | 0 | 20 | 23.33 | 33.33 | 23.33 | 43.33 | 3 |
| NS2 | 129 | 80.09 | 0 | 20 | 25 | 31.67 | 23.33 | 45 | 3 |
| NS2 | 130 | 80.47 | 0 | 20 | 23.33 | 31.67 | 25 | 43.33 | 3 |
| NS2 | 131 | 80.09 | 0 | 21.67 | 23.33 | 31.67 | 23.33 | 45 | 3 |
| NS3 protease/helicase | 270 | 80.7 | 0 | 16.67 | 28.33 | 28.33 | 26.67 | 45 | 3 |
| NS3 protease/helicase | 272 | 80.77 | 0 | 16.67 | 28.33 | 30 | 25 | 45 | 3 |
| NS3 protease/helicase | 277 | 80.89 | 0 | 16.67 | 28.33 | 30 | 25 | 45 | 3 |
| NS3 protease/helicase | 278 | 80.89 | 0 | 16.67 | 28.33 | 28.33 | 26.67 | 45 | 3 |
| NS3 protease/helicase | 280 | 80.24 | 0 | 15 | 30 | 30 | 25 | 45 | 3 |
| NS3 protease/helicase | 281 | 80.24 | 0 | 16.67 | 28.33 | 30 | 25 | 45 | 3 |
| NS3 protease/helicase | 283 | 80.98 | 0 | 18.33 | 26.67 | 30 | 25 | 45 | 3 |
| NS3 protease/helicase | 309 | 80.9 | 0 | 20 | 25 | 23.33 | 31.67 | 45 | 4 |
| NS3 protease/helicase | 310 | 80.39 | 0 | 20 | 25 | 21.67 | 33.33 | 45 | 4 |
| NS3 protease/helicase | 311 | 80.33 | 0 | 20 | 23.33 | 23.33 | 33.33 | 43.33 | 4 |
| NS4A protein | 60 | 81.66 | 0 | 28.33 | 20 | 31.67 | 20 | 48.33 | 3 |
| NS4A protein | 61 | 81.66 | 0 | 30 | 18.33 | 31.67 | 20 | 48.33 | 3 |
| NS4A protein | 62 | 81.97 | 0 | 28.33 | 18.33 | 33.33 | 20 | 46.67 | 3 |
| NS4A protein | 63 | 81.46 | 0 | 28.33 | 18.33 | 35 | 18.33 | 46.67 | 3 |
| NS4A protein | 64 | 81.53 | 0 | 26.67 | 20 | 35 | 18.33 | 46.67 | 3 |
| NS4A protein | 65 | 81.96 | 0 | 28.33 | 20 | 33.33 | 18.33 | 48.33 | 3 |
| NS4A protein | 66 | 81.96 | 0 | 28.33 | 20 | 33.33 | 18.33 | 48.33 | 3 |
| NS4A protein | 67 | 82.6 | 0 | 28.33 | 20 | 33.33 | 18.33 | 48.33 | 3 |
| NS4A protein | 68 | 82.63 | 0 | 28.33 | 20 | 33.33 | 18.33 | 48.33 | 3 |
| NS4A protein | 69 | 81.96 | 0 | 28.33 | 20 | 33.33 | 18.33 | 48.33 | 3 |
| NS4B protein | 547 | 81.84 | 0 | 15 | 30 | 25 | 30 | 45 | 6 |
| NS4B protein | 548 | 81.84 | 0 | 15 | 30 | 23.33 | 31.67 | 45 | 6 |
| NS4B protein | 651 | 81.96 | 0 | 26.67 | 18.33 | 26.67 | 28.33 | 45 | 4 |
| NS4B protein | 652 | 82.25 | 0 | 26.67 | 18.33 | 26.67 | 28.33 | 45 | 4 |
| NS4B protein | 654 | 81.23 | 0 | 26.67 | 18.33 | 28.33 | 26.67 | 45 | 4 |
| NS4B protein | 655 | 81.95 | 0 | 28.33 | 16.67 | 28.33 | 26.67 | 45 | 4 |
| NS4B protein | 666 | 82.5 | 0 | 25 | 20 | 28.33 | 26.67 | 45 | 4 |
| NS4B protein | 667 | 81.99 | 0 | 25 | 20 | 30 | 25 | 45 | 4 |
| NS4B protein | 668 | 81.65 | 0 | 23.33 | 20 | 30 | 26.67 | 43.33 | 4 |
| NS4B protein | 669 | 81.37 | 0 | 25 | 20 | 28.33 | 26.67 | 45 | 4 |
| NS5A protein | 844 | 80.76 | 0 | 20 | 25 | 23.33 | 31.67 | 45 | 4 |
| NS5A protein | 845 | 80.32 | 0 | 20 | 25 | 23.33 | 31.67 | 45 | 4 |

TABLE 1-continued

| Selected viral probes | | | | | | | | |
|---|---|---|---|---|---|---|---|---|
| NS5A protein | 846 | 80.22 | 0 | 20 | 25 | 23.33 | 31.67 | 45 | 4 |
| NS5A protein | 847 | 80.15 | 0 | 20 | 25 | 25 | 30 | 45 | 4 |
| NS5A protein | 848 | 80.05 | 0 | 20 | 25 | 25 | 30 | 45 | 4 |
| NS5A protein | 849 | 80.05 | 0 | 20 | 25 | 26.67 | 28.33 | 45 | 4 |
| NS5A protein | 850 | 79.39 | 0 | 21.67 | 23.33 | 26.67 | 28.33 | 45 | 3 |
| NS5A protein | 851 | 79.19 | 0 | 21.67 | 21.67 | 26.67 | 30 | 43.33 | 3 |
| NS5A protein | 852 | 78.49 | 0 | 21.67 | 20 | 26.67 | 31.67 | 41.67 | 3 |
| NS5A protein | 853 | 78.59 | 0 | 23.33 | 18.33 | 26.67 | 31.67 | 41.67 | 3 |
| NS5B RNA-dependent RNA polymerase | 226 | 82.27 | 0 | 20 | 25 | 30 | 25 | 45 | 4 |
| NS5B RNA-dependent RNA polymerase | 401 | 81.84 | 0 | 16.67 | 28.33 | 28.33 | 26.67 | 45 | 3 |
| NS5B RNA-dependent RNA polymerase | 424 | 79.41 | 0 | 16.67 | 26.67 | 26.67 | 30 | 43.33 | 3 |
| NS5B RNA-dependent RNA polymerase | 444 | 81.36 | 0 | 20 | 25 | 23.33 | 31.67 | 45 | 4 |
| NS5B RNA-dependent RNA polymerase | 491 | 80.71 | 0 | 13.33 | 30 | 23.33 | 33.33 | 43.33 | 5 |
| NS5B RNA-dependent RNA polymerase | 512 | 80.85 | 0 | 18.33 | 26.67 | 25 | 30 | 45 | 5 |
| NS5B RNA-dependent RNA polymerase | 1102 | 80.76 | 0 | 26.67 | 18.33 | 35 | 20 | 45 | 3 |
| NS5B RNA-dependent RNA polymerase | 1248 | 79.68 | 0 | 25 | 18.33 | 28.33 | 28.33 | 43.33 | 3 |
| NS5B RNA-dependent RNA polymerase | 1627 | 80.61 | 0 | 23.33 | 21.67 | 33.33 | 21.67 | 45 | 3 |
| NS5B RNA-dependent RNA polymerase | 1675 | 79.91 | 0 | 20 | 25 | 28.33 | 26.67 | 45 | 2 |
| Gag-Pol | 67 | 80.21 | 0 | 35 | 8.33 | 33.33 | 23.33 | 43.33 | 4 |
| Gag-Pol | 144 | 77.82 | 0 | 28.33 | 11.67 | 40 | 20 | 40 | 4 |
| Gag-Pol | 204 | 80.91 | 0 | 23.33 | 20 | 33.33 | 23.33 | 43.33 | 4 |
| Gag-Pol | 295 | 79.33 | 0 | 28.33 | 13.33 | 43.33 | 15 | 41.67 | 6 |
| Gag-Pol | 355 | 78.04 | 0 | 21.67 | 15 | 40 | 23.33 | 36.67 | 6 |
| Gag-Pol | 450 | 74.91 | 0 | 18.33 | 16.67 | 43.33 | 21.67 | 35 | 4 |
| Gag-Pol | 546 | 81.58 | 0 | 23.33 | 21.67 | 33.33 | 21.67 | 45 | 5 |
| Gag-Pol | 606 | 77.74 | 0 | 21.67 | 15 | 38.33 | 25 | 36.67 | 4 |
| Gag-Pol | 666 | 77.52 | 0 | 26.67 | 11.67 | 36.67 | 25 | 38.33 | 4 |
| Gag-Pol | 726 | 79.82 | 0 | 25 | 18.33 | 35 | 21.67 | 43.33 | 2 |
| gag | 209 | 81.78 | 0 | 26.67 | 18.33 | 26.67 | 28.33 | 45 | 6 |
| gag | 269 | 80.24 | 0 | 31.67 | 11.67 | 38.33 | 18.33 | 43.33 | 3 |
| gag | 342 | 82.47 | 0 | 28.33 | 16.67 | 33.33 | 21.67 | 45 | 3 |
| gag | 402 | 78.85 | 0 | 20 | 18.33 | 43.33 | 18.33 | 38.33 | 4 |
| gag | 545 | 79.58 | 0 | 21.67 | 20 | 31.67 | 26.67 | 41.67 | 4 |
| gag | 605 | 78.28 | 0 | 21.67 | 16.67 | 43.33 | 18.33 | 38.33 | 6 |
| gag | 667 | 80.04 | 0 | 21.67 | 23.33 | 36.67 | 18.33 | 45 | 3 |
| gag | 754 | 75.62 | 0 | 18.33 | 16.67 | 40 | 25 | 35 | 4 |
| gag | 814 | 80.67 | 0 | 26.67 | 18.33 | 38.33 | 16.67 | 45 | 4 |
| gag | 903 | 81.87 | 0 | 28.33 | 16.67 | 36.67 | 18.33 | 45 | 4 |
| Vif | 114 | 78.8 | 0 | 21.67 | 20 | 40 | 18.33 | 41.67 | 6 |
| Vif | 154 | 77.98 | 0 | 13.33 | 25 | 43.33 | 18.33 | 38.33 | 6 |
| Vif | 194 | 78.39 | 0 | 23.33 | 18.33 | 33.33 | 25 | 41.67 | 3 |
| Vif | 234 | 77.97 | 0 | 21.67 | 18.33 | 31.67 | 28.33 | 40 | 3 |
| Vif | 276 | 75.46 | 0 | 13.33 | 21.67 | 28.33 | 36.67 | 35 | 5 |
| Vif | 316 | 78.46 | 0 | 20 | 20 | 45 | 15 | 40 | 5 |
| Vif | 356 | 79.26 | 0 | 33.33 | 10 | 38.33 | 18.33 | 43.33 | 5 |
| Vif | 396 | 78.73 | 0 | 28.33 | 13.33 | 33.33 | 25 | 41.67 | 4 |
| Vif | 436 | 77.87 | 0 | 20 | 20 | 38.33 | 21.67 | 40 | 4 |
| Vif | 476 | 77.27 | 0 | 21.67 | 18.33 | 35 | 25 | 40 | 4 |
| vpr | 78 | 81.1 | 0 | 30 | 15 | 35 | 20 | 45 | 3 |
| vpr | 98 | 79.56 | 0 | 21.67 | 20 | 26.67 | 31.67 | 41.67 | 4 |
| vpr | 118 | 78.61 | 0 | 18.33 | 20 | 30 | 31.67 | 38.33 | 4 |
| vpr | 138 | 79.69 | 0 | 21.67 | 18.33 | 31.67 | 28.33 | 40 | 3 |
| vpr | 158 | 78.79 | 0 | 26.67 | 13.33 | 33.33 | 26.67 | 40 | 4 |
| vpr | 184 | 81.7 | 0 | 28.33 | 16.67 | 26.67 | 28.33 | 45 | 4 |
| vpr | 204 | 78.58 | 0 | 20 | 20 | 25 | 35 | 40 | 4 |
| vpr | 224 | 79.94 | 0 | 28.33 | 15 | 26.67 | 30 | 43.33 | 4 |
| vpr | 244 | 77.34 | 0 | 26.67 | 13.33 | 31.67 | 28.33 | 40 | 4 |
| vpr | 264 | 79.95 | 0 | 28.33 | 16.67 | 38.33 | 16.67 | 45 | 4 |

TABLE 1-continued

| | | Selected viral probes | | | | | | |
|---|---|---|---|---|---|---|---|---|
| tat | 91 | 80.29 | 0 | 18.33 | 26.67 | 30 | 25 | 45 | 3 |
| tat | 218 | 77.17 | 0 | 28.33 | 6.67 | 33.33 | 31.67 | 35 | 3 |
| tat | 285 | 76.51 | 0 | 15 | 20 | 48.33 | 16.67 | 35 | 4 |
| tat | 345 | 79.94 | 0 | 26.67 | 15 | 38.33 | 20 | 41.67 | 3 |
| tat | 405 | 80.08 | 0 | 21.67 | 21.67 | 26.67 | 30 | 43.33 | 4 |
| tat | 572 | 82.24 | 0 | 28.33 | 16.67 | 28.33 | 26.67 | 45 | 3 |
| tat | 692 | 81.72 | 0 | 35 | 10 | 30 | 25 | 45 | 6 |
| tat | 824 | 79.96 | 0 | 30 | 15 | 35 | 20 | 45 | 3 |
| tat | 884 | 77.23 | 0 | 25 | 13.33 | 35 | 26.67 | 38.33 | 3 |
| tat | 944 | 77.7 | 0 | 16.67 | 18.33 | 45 | 20 | 35 | 4 |
| rev | 60 | 78.01 | 0 | 25 | 16.67 | 35 | 23.33 | 41.67 | 3 |
| rev | 134 | 80.4 | 0 | 23.33 | 21.67 | 23.33 | 31.67 | 45 | 2 |
| rev | 231 | 80.23 | 0 | 31.67 | 13.33 | 38.33 | 16.67 | 45 | 2 |
| rev | 320 | 80.29 | 0 | 18.33 | 26.67 | 30 | 25 | 45 | 3 |
| rev | 447 | 77.17 | 0 | 28.33 | 6.67 | 33.33 | 31.67 | 35 | 3 |
| rev | 514 | 76.51 | 0 | 15 | 20 | 48.33 | 16.67 | 35 | 4 |
| rev | 574 | 79.94 | 0 | 26.67 | 15 | 38.33 | 20 | 41.67 | 3 |
| rev | 634 | 80.08 | 0 | 21.67 | 21.67 | 26.67 | 30 | 43.33 | 4 |
| rev | 801 | 82.24 | 0 | 28.33 | 16.67 | 28.33 | 26.67 | 45 | 3 |
| rev | 921 | 81.72 | 0 | 35 | 10 | 30 | 25 | 45 | 6 |
| vpu | 114 | 78.38 | 0 | 30 | 11.67 | 41.67 | 16.67 | 41.67 | 3 |
| vpu | 61 | 85.51 | 0 | 40 | 13.33 | 18.33 | 28.33 | 53.33 | 5 |
| vpu | 62 | 85.89 | 0 | 40 | 15 | 16.67 | 28.33 | 55 | 5 |
| vpu | 64 | 86.58 | 0 | 40 | 15 | 18.33 | 26.67 | 55 | 5 |
| vpu | 66 | 86.64 | 0 | 40 | 15 | 18.33 | 26.67 | 55 | 5 |
| vpu | 67 | 86.64 | 0 | 40 | 15 | 20 | 25 | 55 | 5 |
| vpu | 68 | 85.92 | 0 | 40 | 15 | 18.33 | 26.67 | 55 | 5 |
| vpu | 69 | 85.79 | 0 | 38.33 | 15 | 20 | 26.67 | 53.33 | 5 |
| vpu | 70 | 85.81 | 0 | 38.33 | 15 | 21.67 | 25 | 53.33 | 5 |
| vpu | 71 | 85.37 | 0 | 38.33 | 15 | 21.67 | 25 | 53.33 | 5 |
| asp | 93 | 82.24 | 0 | 28.33 | 16.67 | 28.33 | 26.67 | 45 | 3 |
| asp | 210 | 81.72 | 0 | 35 | 10 | 30 | 25 | 45 | 6 |
| asp | 256 | 80.7 | 0 | 26.67 | 16.67 | 41.67 | 15 | 43.33 | 5 |
| asp | 359 | 80.63 | 0 | 30 | 15 | 35 | 20 | 45 | 2 |
| asp | 389 | 76.87 | 0 | 21.67 | 13.33 | 38.33 | 26.67 | 35 | 3 |
| asp | 419 | 79.95 | 0 | 18.33 | 23.33 | 30 | 28.33 | 41.67 | 4 |
| asp | 449 | 80.68 | 0 | 21.67 | 20 | 38.33 | 20 | 41.67 | 4 |
| asp | 479 | 78.34 | 0 | 16.67 | 20 | 46.67 | 16.67 | 36.67 | 4 |
| asp | 509 | 79.23 | 0 | 16.67 | 23.33 | 43.33 | 16.67 | 40 | 4 |
| asp | 539 | 77.8 | 0 | 25 | 13.33 | 36.67 | 25 | 38.33 | 3 |
| nef | 179 | 80.47 | 0 | 25 | 20 | 38.33 | 16.67 | 45 | 3 |
| nef | 199 | 79.2 | 0 | 28.33 | 15 | 41.67 | 15 | 43.33 | 3 |
| nef | 220 | 79.81 | 0 | 23.33 | 20 | 31.67 | 25 | 43.33 | 3 |
| nef | 300 | 79.39 | 0 | 16.67 | 28.33 | 28.33 | 26.67 | 45 | 3 |
| nef | 320 | 80.05 | 0 | 15 | 28.33 | 33.33 | 23.33 | 43.33 | 3 |
| nef | 348 | 80.65 | 0 | 26.67 | 16.67 | 40 | 16.67 | 43.33 | 6 |
| nef | 368 | 79.99 | 0 | 23.33 | 18.33 | 35 | 23.33 | 41.67 | 6 |
| nef | 388 | 80.05 | 0 | 26.67 | 15 | 35 | 23.33 | 41.67 | 6 |
| nef | 408 | 78.88 | 0 | 16.67 | 25 | 28.33 | 30 | 41.67 | 5 |
| nef | 517 | 81.69 | 0 | 21.67 | 23.33 | 38.33 | 16.67 | 45 | 5 |
| 5' LTR | 155 | 79.1 | 0 | 18.33 | 25 | 25 | 31.67 | 43.33 | 3 |
| 5' LTR | 343 | 79.71 | 0 | 20 | 23.33 | 21.67 | 35 | 43.33 | 3 |
| 5' LTR | 472 | 79.15 | 0 | 25 | 18.33 | 41.67 | 15 | 43.33 | 3 |
| 5' LTR | 502 | 77.55 | 0 | 21.67 | 16.67 | 45 | 16.67 | 38.33 | 3 |
| 5' LTR | 532 | 79.96 | 0 | 28.33 | 13.33 | 43.33 | 15 | 41.67 | 4 |
| 5' LTR | 647 | 81.97 | 0 | 28.33 | 16.67 | 33.33 | 21.67 | 45 | 4 |
| 5' LTR | 715 | 80.36 | 0 | 26.67 | 18.33 | 36.67 | 18.33 | 45 | 2 |
| 5' LTR | 788 | 78.77 | 0 | 23.33 | 18.33 | 33.33 | 25 | 41.67 | 3 |
| 5' LTR | 818 | 75.67 | 0 | 20 | 16.67 | 43.33 | 20 | 36.67 | 5 |
| 5' LTR | 848 | 75.56 | 0 | 26.67 | 11.67 | 41.67 | 20 | 38.33 | 5 |
| gag polyprotein | 430 | 82.46 | 0 | 30 | 15 | 38.33 | 16.67 | 45 | 3 |
| gag polyprotein | 577 | 80.03 | 0 | 25 | 20 | 36.67 | 18.33 | 45 | 4 |
| gag polyprotein | 637 | 81.88 | 0 | 16.67 | 28.33 | 41.67 | 13.33 | 45 | 6 |
| gag polyprotein | 697 | 81.02 | 0 | 21.67 | 21.67 | 40 | 16.67 | 43.33 | 4 |
| gag polyprotein | 757 | 79.55 | 0 | 21.67 | 20 | 41.67 | 16.67 | 41.67 | 4 |
| gag polyprotein | 817 | 80.48 | 0 | 23.33 | 21.67 | 36.67 | 18.33 | 45 | 4 |
| gag polyprotein | 961 | 80.93 | 0 | 25 | 20 | 38.33 | 16.67 | 45 | 3 |
| gag polyprotein | 1021 | 79.57 | 0 | 20 | 20 | 31.67 | 28.33 | 40 | 3 |
| gag polyprotein | 1094 | 81.5 | 0 | 31.67 | 13.33 | 33.33 | 21.67 | 45 | 4 |

TABLE 1-continued

| Selected viral probes | | | | | | | | |
|---|---|---|---|---|---|---|---|---|
| gag polyprotein | 1219 | 80.48 | 0 | 20 | 25 | 45 | 10 | 45 | 4 |
| gag-pol | 60 | 77.83 | 0 | 20 | 21.67 | 35 | 23.33 | 41.67 | 4 |
| gag-pol | 120 | 79.05 | 0 | 18.33 | 23.33 | 35 | 23.33 | 41.67 | 5 |
| gag-pol | 180 | 79.42 | 0 | 23.33 | 20 | 36.67 | 20 | 43.33 | 5 |
| gag-pol | 265 | 80.72 | 0 | 23.33 | 21.67 | 33.33 | 21.67 | 45 | 4 |
| gag-pol | 380 | 78.61 | 0 | 28.33 | 15 | 43.33 | 13.33 | 43.33 | 4 |
| gag-pol | 480 | 80.85 | 0 | 28.33 | 16.67 | 33.33 | 21.67 | 45 | 3 |
| gag-pol | 557 | 76.38 | 0 | 11.67 | 23.33 | 50 | 15 | 35 | 3 |
| gag-pol | 617 | 79.46 | 0 | 30 | 11.67 | 33.33 | 25 | 41.67 | 4 |
| gag-pol | 703 | 76.51 | 0 | 23.33 | 15 | 45 | 16.67 | 38.33 | 3 |
| gag-pol | 764 | 81.32 | 0 | 26.67 | 18.33 | 31.67 | 23.33 | 45 | 3 |
| gp2-vif protein | 209 | 79 | 0 | 18.33 | 25 | 40 | 16.67 | 43.33 | 4 |
| gp2-vif protein | 261 | 80.96 | 0 | 13.33 | 30 | 31.67 | 25 | 43.33 | 4 |
| gp2-vif protein | 311 | 80.06 | 0 | 28.33 | 13.33 | 30 | 28.33 | 41.67 | 4 |
| gp2-vif protein | 341 | 78.94 | 0 | 18.33 | 21.67 | 28.33 | 31.67 | 40 | 3 |
| gp2-vif protein | 372 | 80.21 | 0 | 18.33 | 25 | 35 | 21.67 | 43.33 | 4 |
| gp2-vif protein | 402 | 79.16 | 0 | 18.33 | 23.33 | 31.67 | 26.67 | 41.67 | 4 |
| gp2-vif protein | 432 | 80.3 | 0 | 20 | 23.33 | 33.33 | 23.33 | 43.33 | 5 |
| gp2-vif protein | 464 | 78.01 | 0 | 21.67 | 16.67 | 46.67 | 15 | 38.33 | 5 |
| gp2-vif protein | 494 | 79.25 | 0 | 21.67 | 20 | 38.33 | 20 | 41.67 | 5 |
| gp2-vif protein | 591 | 80.18 | 0 | 26.67 | 18.33 | 38.33 | 16.67 | 45 | 4 |
| gp3-vpx Protein | 120 | 81.55 | 0 | 30 | 15 | 31.67 | 23.33 | 45 | 6 |
| gp3-vpx Protein | 121 | 81.42 | 0 | 28.33 | 15 | 33.33 | 23.33 | 43.33 | 6 |
| gp3-vpx Protein | 122 | 81.16 | 0 | 28.33 | 15 | 33.33 | 23.33 | 43.33 | 6 |
| gp3-vpx Protein | 123 | 80.71 | 0 | 28.33 | 16.67 | 31.67 | 23.33 | 45 | 6 |
| gp3-vpx Protein | 124 | 81.28 | 0 | 28.33 | 16.67 | 31.67 | 23.33 | 45 | 6 |
| gp3-vpx Protein | 126 | 81.53 | 0 | 28.33 | 16.67 | 30 | 25 | 45 | 6 |
| gp3-vpx Protein | 127 | 81.6 | 0 | 28.33 | 16.67 | 30 | 25 | 45 | 6 |
| gp3-vpx Protein | 128 | 81.7 | 0 | 28.33 | 16.67 | 28.33 | 26.67 | 45 | 6 |
| gp3-vpx Protein | 129 | 80.99 | 0 | 26.67 | 16.67 | 28.33 | 28.33 | 43.33 | 5 |
| gp3-vpx Protein | 130 | 80.29 | 0 | 25 | 16.67 | 28.33 | 30 | 41.67 | 5 |
| gp4-vpr protein | 114 | 81.27 | 0 | 18.33 | 26.67 | 38.33 | 16.67 | 45 | 4 |
| gp4-vpr protein | 115 | 80.99 | 0 | 18.33 | 26.67 | 36.67 | 18.33 | 45 | 4 |
| gp4-vpr protein | 116 | 80.45 | 0 | 18.33 | 26.67 | 36.67 | 18.33 | 45 | 4 |
| gp4-vpr protein | 117 | 80.03 | 0 | 18.33 | 25 | 36.67 | 20 | 43.33 | 4 |
| gp4-vpr protein | 118 | 80.37 | 0 | 18.33 | 26.67 | 35 | 20 | 45 | 4 |
| gp4-vpr protein | 119 | 80.45 | 0 | 18.33 | 26.67 | 36.67 | 18.33 | 45 | 4 |
| gp4-vpr protein | 120 | 79.46 | 0 | 18.33 | 25 | 36.67 | 20 | 43.33 | 4 |
| gp4-vpr protein | 121 | 78.83 | 0 | 18.33 | 25 | 36.67 | 20 | 43.33 | 4 |
| gp4-vpr protein | 122 | 79.54 | 0 | 20 | 23.33 | 36.67 | 20 | 43.33 | 4 |
| gp4-vpr protein | 123 | 80.24 | 0 | 21.67 | 23.33 | 35 | 20 | 45 | 3 |
| gp5-tat protein | 174 | 79.14 | 0 | 21.67 | 20 | 23.33 | 35 | 41.67 | 6 |
| gp5-tat protein | 243 | 75.32 | 0 | 25 | 10 | 35 | 30 | 35 | 3 |
| gp5-tat protein | 365 | 76.3 | 0 | 16.67 | 18.33 | 48.33 | 16.67 | 35 | 4 |

TABLE 1-continued

| Selected viral probes | | | | | | | | | |
|---|---|---|---|---|---|---|---|---|---|
| gp5-tat protein | 426 | 80.93 | 0 | 26.67 | 18.33 | 33.33 | 21.67 | 45 | 5 |
| gp5-tat protein | 510 | 81.51 | 0 | 26.67 | 18.33 | 31.67 | 23.33 | 45 | 4 |
| gp5-tat protein | 619 | 82.14 | 0 | 26.67 | 18.33 | 38.33 | 16.67 | 45 | 3 |
| gp5-tat protein | 795 | 81.1 | 0 | 16.67 | 28.33 | 35 | 20 | 45 | 3 |
| gp5-tat protein | 855 | 78.13 | 0 | 25 | 16.67 | 35 | 23.33 | 41.67 | 3 |
| gp5-tat protein | 978 | 81.02 | 0 | 33.33 | 11.67 | 30 | 25 | 45 | 5 |
| gp5-tat protein | 1038 | 77.77 | 0 | 15 | 21.67 | 45 | 18.33 | 36.67 | 3 |
| gp6-rev protein | 121 | 80.43 | 0 | 16.67 | 28.33 | 28.33 | 26.67 | 45 | 3 |
| gp6-rev protein | 319 | 79.14 | 0 | 21.67 | 20 | 23.33 | 35 | 41.67 | 6 |
| gp6-rev protein | 388 | 75.32 | 0 | 25 | 10 | 35 | 30 | 35 | 3 |
| gp6-rev protein | 510 | 76.3 | 0 | 16.67 | 18.33 | 48.33 | 16.67 | 35 | 4 |
| gp6-rev protein | 571 | 80.93 | 0 | 26.67 | 18.33 | 33.33 | 21.67 | 45 | 5 |
| gp6-rev protein | 655 | 81.51 | 0 | 26.67 | 18.33 | 31.67 | 23.33 | 45 | 4 |
| gp6-rev protein | 764 | 82.14 | 0 | 26.67 | 18.33 | 38.33 | 16.67 | 45 | 3 |
| gp6-rev protein | 940 | 81.1 | 0 | 16.67 | 28.33 | 35 | 20 | 45 | 3 |
| gp6-rev protein | 1000 | 78.13 | 0 | 25 | 16.67 | 35 | 23.33 | 41.67 | 3 |
| gp6-rev protein | 1123 | 81.02 | 0 | 33.33 | 11.67 | 30 | 25 | 45 | 5 |
| gp7-env protein | 305 | 80.43 | 0 | 16.67 | 28.33 | 28.33 | 26.67 | 45 | 3 |
| gp7-env protein | 503 | 79.14 | 0 | 21.67 | 20 | 23.33 | 35 | 41.67 | 6 |
| gp7-env protein | 572 | 75.32 | 0 | 25 | 10 | 35 | 30 | 35 | 3 |
| gp7-env protein | 694 | 76.3 | 0 | 16.67 | 18.33 | 48.33 | 16.67 | 35 | 4 |
| gp7-env protein | 755 | 80.93 | 0 | 26.67 | 18.33 | 33.33 | 21.67 | 45 | 5 |
| gp7-env protein | 839 | 81.51 | 0 | 26.67 | 18.33 | 31.67 | 23.33 | 45 | 4 |
| gp7-env protein | 948 | 82.14 | 0 | 26.67 | 18.33 | 38.33 | 16.67 | 45 | 3 |
| gp7-env protein | 1124 | 81.1 | 0 | 16.67 | 28.33 | 35 | 20 | 45 | 3 |
| gp7-env protein | 1184 | 78.13 | 0 | 25 | 16.67 | 35 | 23.33 | 41.67 | 3 |
| gp7-env protein | 1307 | 81.02 | 0 | 33.33 | 11.67 | 30 | 25 | 45 | 5 |
| gp8-nef protein | 66 | 79.96 | 0 | 28.33 | 13.33 | 43.33 | 15 | 41.67 | 4 |
| gp8-nef protein | 181 | 81.97 | 0 | 28.33 | 16.67 | 33.33 | 21.67 | 45 | 4 |
| gp8-nef protein | 249 | 80.36 | 0 | 26.67 | 18.33 | 36.67 | 18.33 | 45 | 2 |
| gp8-nef protein | 322 | 78.77 | 0 | 23.33 | 18.33 | 33.33 | 25 | 41.67 | 3 |
| gp8-nef protein | 352 | 75.67 | 0 | 20 | 16.67 | 43.33 | 20 | 36.67 | 5 |
| gp8-nef protein | 382 | 75.56 | 0 | 26.67 | 11.67 | 41.67 | 20 | 38.33 | 5 |
| gp8-nef protein | 416 | 77.69 | 0 | 28.33 | 10 | 40 | 21.67 | 38.33 | 5 |
| gp8-nef protein | 467 | 76.63 | 0 | 18.33 | 18.33 | 40 | 23.33 | 36.67 | 4 |
| gp8-nef protein | 497 | 79.73 | 0 | 23.33 | 20 | 35 | 21.67 | 43.33 | 3 |
| gp8-nef protein | 527 | 77.26 | 0 | 26.67 | 11.67 | 31.67 | 30 | 38.33 | 4 |
| 3 LTR | 155 | 79.1 | 0 | 18.33 | 25 | 25 | 31.67 | 43.33 | 3 |
| 3 LTR | 343 | 79.71 | 0 | 20 | 23.33 | 21.67 | 35 | 43.33 | 3 |
| 3 LTR | 472 | 79.15 | 0 | 25 | 18.33 | 41.67 | 15 | 43.33 | 3 |
| 3 LTR | 502 | 77.55 | 0 | 21.67 | 16.67 | 45 | 16.67 | 38.33 | 3 |

TABLE 1-continued

| Selected viral probes | | | | | | | | |
|---|---|---|---|---|---|---|---|---|
| 3 LTR | 532 | 79.96 | 0 | 28.33 | 13.33 | 43.33 | 15 | 41.67 | 4 |
| 3 LTR | 647 | 81.97 | 0 | 28.33 | 16.67 | 33.33 | 21.67 | 45 | 4 |
| 3 LTR | 715 | 80.36 | 0 | 26.67 | 18.33 | 36.67 | 18.33 | 45 | 2 |
| 3 LTR | 788 | 78.77 | 0 | 23.33 | 18.33 | 33.33 | 25 | 41.67 | 3 |
| 3 LTR | 818 | 75.67 | 0 | 20 | 16.67 | 43.33 | 20 | 36.67 | 5 |
| 3 LTR | 848 | 75.56 | 0 | 26.67 | 11.67 | 41.67 | 20 | 38.33 | 5 |
| gag | 364 | 81.2 | 0 | 21.67 | 23.33 | 35 | 20 | 45 | 5 |
| gag | 365 | 81.2 | 0 | 21.67 | 23.33 | 36.67 | 18.33 | 45 | 5 |
| gag | 366 | 80.69 | 0 | 21.67 | 23.33 | 38.33 | 16.67 | 45 | 5 |
| gag | 367 | 80.69 | 0 | 20 | 25 | 38.33 | 16.67 | 45 | 5 |
| gag | 368 | 81.23 | 0 | 20 | 25 | 40 | 15 | 45 | 5 |
| gag | 369 | 81.51 | 0 | 20 | 25 | 40 | 15 | 45 | 5 |
| gag | 370 | 81.54 | 0 | 20 | 25 | 41.67 | 13.33 | 45 | 5 |
| gag | 374 | 81.41 | 0 | 18.33 | 26.67 | 40 | 15 | 45 | 5 |
| gag | 375 | 81.36 | 0 | 16.67 | 26.67 | 41.67 | 15 | 43.33 | 5 |
| gag | 376 | 81.36 | 0 | 16.67 | 26.67 | 40 | 16.67 | 43.33 | 5 |
| pro | 79 | 81.5 | 0 | 16.67 | 28.33 | 35 | 20 | 45 | 6 |
| pro | 80 | 81.38 | 0 | 15 | 28.33 | 36.67 | 20 | 43.33 | 6 |
| pro | 81 | 80.97 | 0 | 16.67 | 28.33 | 36.67 | 18.33 | 45 | 6 |
| pro | 82 | 80.97 | 0 | 18.33 | 26.67 | 36.67 | 18.33 | 45 | 6 |
| pro | 83 | 81.28 | 0 | 18.33 | 25 | 38.33 | 18.33 | 43.33 | 6 |
| pro | 84 | 80.99 | 0 | 18.33 | 26.67 | 36.67 | 18.33 | 45 | 6 |
| pro | 85 | 80.99 | 0 | 16.67 | 28.33 | 36.67 | 18.33 | 45 | 6 |
| pro | 86 | 81.71 | 0 | 18.33 | 26.67 | 36.67 | 18.33 | 45 | 6 |
| pro | 105 | 81.26 | 0 | 16.67 | 28.33 | 38.33 | 16.67 | 45 | 6 |
| pro | 106 | 81.26 | 0 | 15 | 30 | 38.33 | 16.67 | 45 | 6 |
| Pol | 217 | 81.86 | 0 | 20 | 25 | 28.33 | 26.67 | 45 | 3 |
| Pol | 331 | 81.66 | 0 | 13.33 | 30 | 38.33 | 18.33 | 43.33 | 4 |
| Pol | 391 | 77.91 | 0 | 11.67 | 28.33 | 31.67 | 28.33 | 40 | 3 |
| Pol | 542 | 79.82 | 0 | 11.67 | 30 | 31.67 | 26.67 | 41.67 | 3 |
| Pol | 609 | 81.28 | 0 | 18.33 | 26.67 | 30 | 25 | 45 | 3 |
| Pol | 679 | 80.45 | 0 | 18.33 | 26.67 | 26.67 | 28.33 | 45 | 4 |
| Pol | 1118 | 79.19 | 0 | 11.67 | 30 | 25 | 33.33 | 41.67 | 3 |
| Pol | 1260 | 81.34 | 0 | 15 | 30 | 26.67 | 28.33 | 45 | 5 |
| Pol | 1351 | 81.27 | 0 | 16.67 | 28.33 | 21.67 | 33.33 | 45 | 4 |
| Pol | 1411 | 79.74 | 0 | 16.67 | 25 | 33.33 | 25 | 41.67 | 5 |
| rex | 109 | 81.24 | 0 | 18.33 | 26.67 | 35 | 20 | 45 | 5 |
| rex | 169 | 76.49 | 0 | 6.67 | 30 | 26.67 | 36.67 | 36.67 | 4 |
| rex | 262 | 77.12 | 0 | 6.67 | 30 | 30 | 33.33 | 36.67 | 3 |
| rex | 479 | 81.27 | 0 | 15 | 30 | 26.67 | 28.33 | 45 | 4 |
| rex | 1077 | 80.71 | 0 | 18.33 | 26.67 | 21.67 | 33.33 | 45 | 4 |
| rex | 1748 | 78.44 | 0 | 8.33 | 30 | 35 | 26.67 | 38.33 | 3 |
| rex | 1986 | 77.3 | 0 | 11.67 | 28.33 | 30 | 30 | 40 | 6 |
| rex | 2091 | 82.63 | 0 | 18.33 | 26.67 | 36.67 | 18.33 | 45 | 5 |
| rex | 2151 | 78.28 | 0 | 16.67 | 21.67 | 40 | 21.67 | 38.33 | 3 |
| rex | 2516 | 81.15 | 0 | 16.67 | 28.33 | 20 | 35 | 45 | 2 |
| tax | 109 | 81.24 | 0 | 18.33 | 26.67 | 35 | 20 | 45 | 5 |
| tax | 169 | 76.49 | 0 | 6.67 | 30 | 26.67 | 36.67 | 36.67 | 4 |
| tax | 262 | 77.12 | 0 | 6.67 | 30 | 30 | 33.33 | 36.67 | 3 |
| tax | 479 | 81.27 | 0 | 15 | 30 | 26.67 | 28.33 | 45 | 4 |
| tax | 1077 | 80.71 | 0 | 18.33 | 26.67 | 21.67 | 33.33 | 45 | 4 |
| tax | 1748 | 78.44 | 0 | 8.33 | 30 | 35 | 26.67 | 38.33 | 3 |
| tax | 1986 | 77.3 | 0 | 11.67 | 28.33 | 30 | 30 | 40 | 6 |
| tax | 2091 | 82.63 | 0 | 18.33 | 26.67 | 36.67 | 18.33 | 45 | 5 |
| tax | 2151 | 78.28 | 0 | 16.67 | 21.67 | 40 | 21.67 | 38.33 | 3 |
| tax | 2516 | 81.15 | 0 | 16.67 | 28.33 | 20 | 35 | 45 | 2 |
| env | 276 | 75.75 | 0 | 13.33 | 23.33 | 33.33 | 30 | 36.67 | 4 |
| env | 316 | 79.9 | 0 | 25 | 16.67 | 31.67 | 26.67 | 41.67 | 4 |
| env | 383 | 82.22 | 0 | 16.67 | 28.33 | 40 | 15 | 45 | 5 |
| env | 423 | 76.35 | 0 | 15 | 20 | 45 | 20 | 35 | 5 |
| env | 806 | 80.64 | 0 | 16.67 | 28.33 | 20 | 35 | 45 | 2 |
| env | 847 | 77.56 | 0 | 10 | 26.67 | 31.67 | 31.67 | 36.67 | 4 |
| env | 1014 | 80.5 | 0 | 15 | 30 | 18.33 | 36.67 | 45 | 5 |
| env | 1080 | 78.82 | 0 | 13.33 | 25 | 33.33 | 28.33 | 38.33 | 4 |
| env | 1171 | 80.15 | 0 | 13.33 | 30 | 23.33 | 33.33 | 43.33 | 4 |
| env | 1211 | 80.16 | 0 | 20 | 23.33 | 31.67 | 25 | 43.33 | 5 |
| 5' LTR | 502 | 80.91 | 0 | 28.33 | 16.67 | 36.67 | 18.33 | 45 | 4 |
| 5' LTR | 503 | 80.27 | 0 | 26.67 | 18.33 | 36.67 | 18.33 | 45 | 4 |
| 5' LTR | 504 | 80.93 | 0 | 26.67 | 18.33 | 36.67 | 18.33 | 45 | 4 |
| 5' LTR | 506 | 81 | 0 | 28.33 | 16.67 | 36.67 | 18.33 | 45 | 4 |
| 5' LTR | 507 | 80.3 | 0 | 26.67 | 16.67 | 36.67 | 20 | 43.33 | 4 |
| 5' LTR | 508 | 80.17 | 0 | 25 | 16.67 | 36.67 | 21.67 | 41.67 | 4 |
| 5' LTR | 509 | 79.64 | 0 | 25 | 16.67 | 38.33 | 20 | 41.67 | 4 |
| 5' LTR | 510 | 78.94 | 0 | 23.33 | 16.67 | 40 | 20 | 40 | 4 |
| 5' LTR | 511 | 78.88 | 0 | 21.67 | 16.67 | 41.67 | 20 | 38.33 | 4 |
| 5' LTR | 513 | 77.51 | 0 | 20 | 16.67 | 41.67 | 21.67 | 36.67 | 4 |
| gp1-tax protein | 63 | 83.12 | 0 | 15 | 33.33 | 26.67 | 25 | 48.33 | 6 |
| gp1-tax protein | 64 | 83.12 | 0 | 15 | 33.33 | 28.33 | 23.33 | 48.33 | 5 |

TABLE 1-continued

| Selected viral probes | | | | | | | | |
|---|---|---|---|---|---|---|---|---|
| gp1-tax protein | 65 | 83.12 | 0 | 15 | 33.33 | 30 | 21.67 | 48.33 | 5 |
| gp1-tax protein | 67 | 83.24 | 0 | 15 | 35 | 31.67 | 18.33 | 50 | 5 |
| gp1-tax protein | 71 | 83.33 | 0 | 16.67 | 35 | 33.33 | 15 | 51.67 | 4 |
| gp1-tax protein | 72 | 83.33 | 0 | 16.67 | 35 | 33.33 | 15 | 51.67 | 4 |
| gp1-tax protein | 73 | 83.05 | 0 | 16.67 | 33.33 | 33.33 | 16.67 | 50 | 4 |
| gp1-tax protein | 74 | 83 | 0 | 16.67 | 31.67 | 35 | 16.67 | 48.33 | 4 |
| gp1-tax protein | 75 | 82.67 | 0 | 16.67 | 33.33 | 35 | 15 | 50 | 4 |
| gp1-tax protein | 76 | 83.07 | 0 | 16.67 | 31.67 | 35 | 16.67 | 48.33 | 4 |
| gs1 | 301 | 80.91 | 0 | 28.33 | 16.67 | 36.67 | 18.33 | 45 | 4 |
| gs1 | 593 | 80.6 | 0 | 23.33 | 21.67 | 30 | 25 | 45 | 4 |
| gs1 | 737 | 78.82 | 0 | 10 | 30 | 30 | 30 | 40 | 5 |
| gs1 | 830 | 80.73 | 0 | 13.33 | 30 | 30 | 26.67 | 43.33 | 4 |
| gs1 | 970 | 80.42 | 0 | 20 | 25 | 35 | 20 | 45 | 4 |
| gs1 | 1573 | 80.03 | 0 | 13.33 | 30 | 30 | 26.67 | 43.33 | 3 |
| gs1 | 1927 | 80.81 | 0 | 13.33 | 30 | 43.33 | 13.33 | 43.33 | 4 |
| gs1 | 2135 | 81.49 | 0 | 15 | 30 | 31.67 | 23.33 | 45 | 4 |
| gs1 | 2399 | 81.19 | 0 | 16.67 | 28.33 | 30 | 25 | 45 | 2 |
| gs1 | 2495 | 81.23 | 0 | 20 | 25 | 36.67 | 18.33 | 45 | 4 |
| Gag-Pro-Pol | 212 | 82.08 | 0 | 20 | 25 | 28.33 | 26.67 | 45 | 4 |
| Gag-Pro-Pol | 331 | 81.97 | 0 | 18.33 | 26.67 | 33.33 | 21.67 | 45 | 4 |
| Gag-Pro-Pol | 394 | 77.04 | 0 | 8.33 | 30 | 36.67 | 25 | 38.33 | 4 |
| Gag-Pro-Pol | 504 | 78.39 | 0 | 11.67 | 30 | 30 | 28.33 | 41.67 | 4 |
| Gag-Pro-Pol | 623 | 81.77 | 0 | 20 | 25 | 30 | 25 | 45 | 5 |
| Gag-Pro-Pol | 802 | 81.24 | 0 | 15 | 30 | 31.67 | 23.33 | 45 | 3 |
| Gag-Pro-Pol | 1106 | 80.47 | 0 | 13.33 | 30 | 26.67 | 30 | 43.33 | 4 |
| Gag-Pro-Pol | 1585 | 79.64 | 0 | 15 | 30 | 30 | 25 | 45 | 3 |
| Gag-Pro-Pol | 1684 | 81.71 | 0 | 16.67 | 28.33 | 28.33 | 26.67 | 45 | 4 |
| Gag-Pro-Pol | 1911 | 80.7 | 0 | 20 | 25 | 31.67 | 23.33 | 45 | 3 |
| gp2-gag polyprotein | 376 | 81.37 | 0 | 15 | 30 | 43.33 | 11.67 | 45 | 6 |
| gp2-gag polyprotein | 379 | 82.65 | 0 | 15 | 30 | 43.33 | 11.67 | 45 | 6 |
| gp2-gag polyprotein | 380 | 82.37 | 0 | 15 | 30 | 41.67 | 13.33 | 45 | 6 |
| gp2-gag polyprotein | 393 | 80.15 | 0 | 11.67 | 30 | 38.33 | 20 | 41.67 | 6 |
| gp2-gag polyprotein | 394 | 79.59 | 0 | 11.67 | 30 | 38.33 | 20 | 41.67 | 6 |
| gp2-gag polyprotein | 395 | 79.44 | 0 | 11.67 | 30 | 38.33 | 20 | 41.67 | 6 |
| gp2-gag polyprotein | 399 | 80.74 | 0 | 13.33 | 30 | 36.67 | 20 | 43.33 | 6 |
| gp2-gag polyprotein | 400 | 81.46 | 0 | 13.33 | 30 | 36.67 | 20 | 43.33 | 6 |
| gp2-gag polyprotein | 401 | 81.46 | 0 | 13.33 | 30 | 38.33 | 18.33 | 43.33 | 6 |
| gp2-gag polyprotein | 402 | 81.02 | 0 | 13.33 | 30 | 40 | 16.67 | 43.33 | 6 |
| gp4-rex 26 kD protein | 491 | 78.63 | 0 | 10 | 30 | 30 | 30 | 40 | 6 |
| gp4-rex 26 kD protein | 541 | 80.11 | 0 | 13.33 | 30 | 30 | 26.67 | 43.33 | 6 |
| gp4-rex 26 kD protein | 839 | 80.81 | 0 | 13.33 | 30 | 43.33 | 13.33 | 43.33 | 4 |
| gp4-rex 26 kD protein | 1056 | 79.23 | 0 | 11.67 | 30 | 31.67 | 26.67 | 41.67 | 3 |
| gp4-rex 26 kD protein | 1325 | 80.73 | 0 | 20 | 23.33 | 28.33 | 28.33 | 43.33 | 3 |
| gp4-rex 26 kD protein | 1412 | 81.46 | 0 | 18.33 | 25 | 38.33 | 18.33 | 43.33 | 5 |
| gp4-rex 26 kD protein | 1452 | 79.8 | 0 | 13.33 | 30 | 38.33 | 18.33 | 43.33 | 5 |
| gp4-rex 26 kD protein | 1864 | 80.7 | 0 | 20 | 25 | 26.67 | 28.33 | 45 | 3 |
| gp4-rex 26 kD protein | 2089 | 80.18 | 0 | 15 | 28.33 | 28.33 | 28.33 | 43.33 | 3 |
| gp4-rex 26 kD protein | 2251 | 80.81 | 0 | 18.33 | 26.67 | 35 | 20 | 45 | 6 |
| gp5-tax protein | 60 | 78.34 | 0 | 20 | 20 | 33.33 | 26.67 | 40 | 4 |
| gp5-tax protein | 191 | 78.82 | 0 | 10 | 30 | 30 | 30 | 40 | 5 |
| gp5-tax protein | 284 | 80.73 | 0 | 13.33 | 30 | 30 | 26.67 | 43.33 | 4 |
| gp5-tax protein | 424 | 80.42 | 0 | 20 | 25 | 35 | 20 | 45 | 4 |
| gp5-tax protein | 1027 | 80.03 | 0 | 13.33 | 30 | 30 | 26.67 | 43.33 | 3 |
| gp5-tax protein | 1381 | 80.81 | 0 | 13.33 | 30 | 43.33 | 13.33 | 43.33 | 4 |
| gp5-tax protein | 1589 | 81.49 | 0 | 15 | 30 | 31.67 | 23.33 | 45 | 4 |
| gp5-tax protein | 1853 | 81.19 | 0 | 16.67 | 28.33 | 30 | 25 | 45 | 2 |
| gp5-tax protein | 1949 | 81.23 | 0 | 20 | 25 | 36.67 | 18.33 | 45 | 4 |
| gp5-tax protein | 2403 | 80.99 | 0 | 20 | 25 | 25 | 30 | 45 | 3 |

TABLE 1-continued

| Selected viral probes | | | | | | | | |
|---|---|---|---|---|---|---|---|---|
| gp6-env peptide | 60 | 79.45 | 0 | 11.67 | 30 | 38.33 | 20 | 41.67 | 4 |
| gp6-env peptide | 302 | 80.73 | 0 | 20 | 23.33 | 28.33 | 28.33 | 43.33 | 3 |
| gp6-env peptide | 389 | 81.46 | 0 | 18.33 | 25 | 38.33 | 18.33 | 43.33 | 5 |
| gp6-env peptide | 429 | 79.8 | 0 | 13.33 | 30 | 38.33 | 18.33 | 43.33 | 5 |
| gp6-env peptide | 841 | 80.7 | 0 | 20 | 25 | 26.67 | 28.33 | 45 | 3 |
| gp6-env peptide | 863 | 80.06 | 0 | 13.33 | 30 | 33.33 | 23.33 | 43.33 | 3 |
| gp6-env peptide | 1066 | 80.18 | 0 | 15 | 28.33 | 28.33 | 28.33 | 43.33 | 3 |
| gp6-env peptide | 1087 | 80.45 | 0 | 20 | 25 | 28.33 | 26.67 | 45 | 3 |
| gp6-env peptide | 1228 | 80.81 | 0 | 18.33 | 26.67 | 35 | 20 | 45 | 6 |
| gp6-env peptide | 1456 | 79.38 | 0 | 11.67 | 30 | 21.67 | 36.67 | 41.67 | 4 |
| 3 LTR | 502 | 80.91 | 0 | 28.33 | 16.67 | 36.67 | 18.33 | 45 | 4 |
| 3 LTR | 503 | 80.27 | 0 | 26.67 | 18.33 | 36.67 | 18.33 | 45 | 4 |
| 3 LTR | 504 | 80.93 | 0 | 26.67 | 18.33 | 36.67 | 18.33 | 45 | 4 |
| 3 LTR | 506 | 81 | 0 | 28.33 | 16.67 | 36.67 | 18.33 | 45 | 4 |
| 3 LTR | 507 | 80.3 | 0 | 26.67 | 16.67 | 36.67 | 20 | 43.33 | 4 |
| 3 LTR | 508 | 80.17 | 0 | 25 | 16.67 | 36.67 | 21.67 | 41.67 | 4 |
| 3 LTR | 509 | 79.64 | 0 | 25 | 16.67 | 38.33 | 20 | 41.67 | 4 |
| 3 LTR | 510 | 78.94 | 0 | 23.33 | 16.67 | 40 | 20 | 40 | 4 |
| 3 LTR | 511 | 78.88 | 0 | 21.67 | 16.67 | 41.67 | 20 | 38.33 | 4 |
| 3 LTR | 513 | 77.51 | 0 | 20 | 16.67 | 41.67 | 21.67 | 36.67 | 4 |
| anchored capsid protein C | 71 | 81.86 | 0 | 26.67 | 18.33 | 41.67 | 13.33 | 45 | 4 |
| anchored capsid protein C | 72 | 81.77 | 0 | 26.67 | 18.33 | 40 | 15 | 45 | 4 |
| anchored capsid protein C | 73 | 81.13 | 0 | 26.67 | 18.33 | 40 | 15 | 45 | 4 |
| anchored capsid protein C | 74 | 81.13 | 0 | 28.33 | 16.67 | 40 | 15 | 45 | 4 |
| anchored capsid protein C | 75 | 80.86 | 0 | 26.67 | 16.67 | 41.67 | 15 | 43.33 | 4 |
| anchored capsid protein C | 76 | 80.86 | 0 | 28.33 | 15 | 41.67 | 15 | 43.33 | 4 |
| anchored capsid protein C | 84 | 81.58 | 0 | 28.33 | 15 | 43.33 | 13.33 | 43.33 | 4 |
| anchored capsid protein C | 88 | 81.3 | 0 | 26.67 | 16.67 | 43.33 | 13.33 | 43.33 | 4 |
| anchored capsid protein C | 89 | 81.38 | 0 | 26.67 | 18.33 | 43.33 | 11.67 | 45 | 4 |
| anchored capsid protein C | 91 | 82.19 | 0 | 28.33 | 16.67 | 41.67 | 13.33 | 45 | 4 |
| membrane glycoprotein precursor prM | 147 | 81.75 | 0 | 28.33 | 16.67 | 30 | 25 | 45 | 5 |
| membrane glycoprotein precursor prM | 148 | 81.23 | 0 | 28.33 | 16.67 | 30 | 25 | 45 | 5 |
| membrane glycoprotein precursor prM | 149 | 80.51 | 0 | 28.33 | 16.67 | 30 | 25 | 45 | 5 |
| membrane glycoprotein precursor prM | 150 | 80.31 | 0 | 26.67 | 16.67 | 31.67 | 25 | 43.33 | 5 |
| membrane glycoprotein precursor prM | 151 | 80.31 | 0 | 25 | 18.33 | 31.67 | 25 | 43.33 | 5 |
| membrane glycoprotein precursor prM | 152 | 80.51 | 0 | 25 | 20 | 31.67 | 23.33 | 45 | 5 |
| membrane glycoprotein precursor prM | 153 | 80.66 | 0 | 25 | 20 | 31.67 | 23.33 | 45 | 5 |
| membrane glycoprotein precursor prM | 154 | 81.23 | 0 | 25 | 20 | 31.67 | 23.33 | 45 | 5 |
| membrane glycoprotein precursor prM | 155 | 81.23 | 0 | 25 | 20 | 33.33 | 21.67 | 45 | 5 |
| membrane glycoprotein precursor prM | 156 | 80.53 | 0 | 25 | 18.33 | 35 | 21.67 | 43.33 | 5 |
| envelope protein E | 336 | 82.12 | 0 | 20 | 25 | 36.67 | 18.33 | 45 | 3 |
| envelope protein E | 624 | 81.25 | 0 | 26.67 | 16.67 | 26.67 | 30 | 43.33 | 3 |
| envelope protein E | 654 | 79.31 | 0 | 31.67 | 10 | 35 | 23.33 | 41.67 | 5 |
| envelope protein E | 684 | 80.21 | 0 | 28.33 | 13.33 | 30 | 28.33 | 41.67 | 4 |

TABLE 1-continued

| Selected viral probes | | | | | | | | | |
|---|---|---|---|---|---|---|---|---|---|
| envelope protein E | 716 | 82.63 | 0 | 23.33 | 21.67 | 25 | 30 | 45 | 4 |
| envelope protein E | 909 | 81.01 | 0 | 26.67 | 18.33 | 25 | 30 | 45 | 3 |
| envelope protein E | 1111 | 79.43 | 0 | 25 | 18.33 | 31.67 | 25 | 43.33 | 5 |
| envelope protein E | 1141 | 78.97 | 0 | 21.67 | 20 | 40 | 18.33 | 41.67 | 3 |
| envelope protein E | 1185 | 82.37 | 0 | 20 | 25 | 31.67 | 23.33 | 45 | 3 |
| envelope protein E | 1414 | 79.7 | 0 | 26.67 | 18.33 | 31.67 | 23.33 | 45 | 2 |
| nonstructural protein NS1 | 86 | 81.31 | 0 | 30 | 15 | 36.67 | 18.33 | 45 | 4 |
| nonstructural protein NS1 | 459 | 82.08 | 0 | 33.33 | 11.67 | 30 | 25 | 45 | 3 |
| nonstructural protein NS1 | 491 | 81.68 | 0 | 23.33 | 21.67 | 31.67 | 23.33 | 45 | 3 |
| nonstructural protein NS1 | 540 | 80.7 | 0 | 25 | 20 | 36.67 | 18.33 | 45 | 2 |
| nonstructural protein NS1 | 631 | 81.55 | 0 | 30 | 15 | 23.33 | 31.67 | 45 | 4 |
| nonstructural protein NS1 | 700 | 81.52 | 0 | 21.67 | 21.67 | 28.33 | 28.33 | 43.33 | 4 |
| nonstructural protein NS1 | 732 | 79.8 | 0 | 28.33 | 13.33 | 33.33 | 25 | 41.67 | 5 |
| nonstructural protein NS1 | 927 | 80.43 | 0 | 26.67 | 18.33 | 31.67 | 23.33 | 45 | 3 |
| nonstructural protein NS1 | 960 | 80.83 | 0 | 18.33 | 25 | 40 | 16.67 | 43.33 | 3 |
| nonstructural protein NS1 | 1003 | 80.82 | 0 | 26.67 | 18.33 | 30 | 25 | 45 | 3 |
| nonstructural protein NS2A | 110 | 80.91 | 0 | 20 | 25 | 33.33 | 21.67 | 45 | 6 |
| nonstructural protein NS2A | 193 | 81.59 | 0 | 31.67 | 13.33 | 23.33 | 31.67 | 45 | 2 |
| nonstructural protein NS2A | 281 | 81.21 | 0 | 21.67 | 23.33 | 30 | 25 | 45 | 3 |
| nonstructural protein NS2A | 301 | 81.07 | 0 | 25 | 20 | 28.33 | 26.67 | 45 | 2 |
| nonstructural protein NS2A | 381 | 81.95 | 0 | 21.67 | 20 | 18.33 | 40 | 41.67 | 4 |
| nonstructural protein NS2A | 401 | 81.59 | 0 | 26.67 | 16.67 | 21.67 | 35 | 43.33 | 4 |
| nonstructural protein NS2A | 429 | 80.89 | 0 | 26.67 | 16.67 | 26.67 | 30 | 43.33 | 4 |
| nonstructural protein NS2A | 451 | 81.2 | 0 | 23.33 | 21.67 | 30 | 25 | 45 | 3 |
| nonstructural protein NS2A | 547 | 81.37 | 0 | 25 | 20 | 21.67 | 33.33 | 45 | 5 |
| nonstructural protein NS2A | 588 | 80.63 | 0 | 26.67 | 18.33 | 16.67 | 38.33 | 45 | 5 |
| nonstructural protein NS2B | 60 | 80.85 | 0 | 20 | 25 | 28.33 | 26.67 | 45 | 4 |
| nonstructural protein NS2B | 145 | 81.64 | 0 | 25 | 20 | 31.67 | 23.33 | 45 | 3 |
| nonstructural protein NS2B | 148 | 81.54 | 0 | 25 | 20 | 31.67 | 23.33 | 45 | 3 |
| nonstructural protein NS2B | 149 | 81.54 | 0 | 25 | 20 | 33.33 | 21.67 | 45 | 3 |
| nonstructural protein NS2B | 152 | 81.58 | 0 | 25 | 20 | 31.67 | 23.33 | 45 | 3 |
| nonstructural protein NS2B | 154 | 81.58 | 0 | 26.67 | 18.33 | 30 | 25 | 45 | 3 |
| nonstructural protein NS2B | 155 | 81.11 | 0 | 26.67 | 18.33 | 31.67 | 23.33 | 45 | 3 |
| nonstructural protein NS2B | 156 | 80.29 | 0 | 28.33 | 16.67 | 31.67 | 23.33 | 45 | 3 |
| nonstructural protein NS2B | 157 | 80.67 | 0 | 26.67 | 16.67 | 31.67 | 25 | 43.33 | 3 |
| nonstructural protein NS2B | 158 | 80.7 | 0 | 26.67 | 16.67 | 31.67 | 25 | 43.33 | 3 |
| nonstructural protein NS3 | 137 | 80.84 | 0 | 30 | 15 | 38.33 | 16.67 | 45 | 3 |
| nonstructural protein NS3 | 267 | 81.55 | 0 | 26.67 | 18.33 | 28.33 | 26.67 | 45 | 6 |
| nonstructural protein NS3 | 346 | 80.83 | 0 | 25 | 20 | 33.33 | 21.67 | 45 | 4 |

TABLE 1-continued

| Selected viral probes | | | | | | | | |
|---|---|---|---|---|---|---|---|---|
| nonstructural protein NS3 | 641 | 81.63 | 0 | 26.67 | 18.33 | 33.33 | 21.67 | 45 | 5 |
| nonstructural protein NS3 | 701 | 79.88 | 0 | 28.33 | 15 | 36.67 | 20 | 43.33 | 4 |
| nonstructural protein NS3 | 761 | 81.94 | 0 | 26.67 | 18.33 | 31.67 | 23.33 | 45 | 4 |
| nonstructural protein NS3 | 898 | 81.24 | 0 | 15 | 30 | 30 | 25 | 45 | 3 |
| nonstructural protein NS3 | 1101 | 81.77 | 0 | 23.33 | 21.67 | 25 | 30 | 45 | 3 |
| nonstructural protein NS3 | 1258 | 80.94 | 0 | 23.33 | 21.67 | 43.33 | 11.67 | 45 | 3 |
| nonstructural protein NS3 | 1430 | 82.18 | 0 | 26.67 | 18.33 | 28.33 | 26.67 | 45 | 3 |
| nonstructural protein NS4A | 207 | 81.11 | 0 | 23.33 | 21.67 | 18.33 | 36.67 | 45 | 3 |
| nonstructural protein NS4A | 208 | 81.05 | 0 | 21.67 | 21.67 | 20 | 36.67 | 43.33 | 3 |
| nonstructural protein NS4A | 209 | 80.67 | 0 | 21.67 | 23.33 | 18.33 | 36.67 | 45 | 3 |
| nonstructural protein NS4A | 210 | 80.32 | 0 | 21.67 | 21.67 | 20 | 36.67 | 43.33 | 3 |
| nonstructural protein NS4A | 211 | 80.23 | 0 | 21.67 | 21.67 | 20 | 36.67 | 43.33 | 3 |
| nonstructural protein NS4A | 212 | 80.69 | 0 | 21.67 | 21.67 | 21.67 | 35 | 43.33 | 3 |
| nonstructural protein NS4A | 213 | 80.32 | 0 | 21.67 | 23.33 | 20 | 35 | 45 | 3 |
| nonstructural protein NS4A | 214 | 80.69 | 0 | 21.67 | 21.67 | 20 | 36.67 | 43.33 | 3 |
| nonstructural protein NS4A | 215 | 80.26 | 0 | 21.67 | 21.67 | 20 | 36.67 | 43.33 | 3 |
| nonstructural protein NS4A | 216 | 79.62 | 0 | 21.67 | 21.67 | 20 | 36.67 | 43.33 | 3 |
| nonstructural protein NS4B | 63 | 76.76 | 0 | 15 | 20 | 43.33 | 21.67 | 35 | 5 |
| nonstructural protein NS4B | 83 | 80.89 | 0 | 23.33 | 20 | 30 | 26.67 | 43.33 | 5 |
| nonstructural protein NS4B | 260 | 80.89 | 0 | 30 | 15 | 26.67 | 28.33 | 45 | 3 |
| nonstructural protein NS4B | 286 | 81.85 | 0 | 21.67 | 23.33 | 35 | 20 | 45 | 3 |
| nonstructural protein NS4B | 581 | 79.07 | 0 | 11.67 | 30 | 35 | 23.33 | 41.67 | 3 |
| nonstructural protein NS4B | 601 | 78.17 | 0 | 11.67 | 26.67 | 35 | 26.67 | 38.33 | 3 |
| nonstructural protein NS4B | 626 | 81.65 | 0 | 15 | 30 | 31.67 | 23.33 | 45 | 3 |
| nonstructural protein NS4B | 718 | 80.6 | 0 | 31.67 | 11.67 | 26.67 | 30 | 43.33 | 3 |
| nonstructural protein NS4B | 738 | 79.4 | 0 | 30 | 10 | 35 | 25 | 40 | 3 |
| nonstructural protein NS4B | 758 | 80.52 | 0 | 33.33 | 10 | 31.67 | 25 | 43.33 | 3 |
| nonstructural protein NS5 | 60 | 77.17 | 0 | 23.33 | 16.67 | 36.67 | 23.33 | 40 | 3 |
| nonstructural protein NS6 | 120 | 80.17 | 0 | 26.67 | 18.33 | 36.67 | 18.33 | 45 | 4 |
| nonstructural protein NS7 | 236 | 81.19 | 0 | 26.67 | 18.33 | 40 | 15 | 45 | 4 |
| nonstructural protein NS8 | 555 | 81.66 | 0 | 31.67 | 13.33 | 31.67 | 23.33 | 45 | 3 |
| nonstructural protein NS9 | 615 | 81.92 | 0 | 21.67 | 23.33 | 25 | 30 | 45 | 4 |
| nonstructural protein NS10 | 1363 | 81.34 | 0 | 28.33 | 15 | 41.67 | 15 | 43.33 | 6 |
| nonstructural protein NS11 | 1461 | 82.15 | 0 | 33.33 | 11.67 | 35 | 20 | 45 | 4 |
| nonstructural protein NS12 | 1521 | 81.38 | 0 | 30 | 15 | 33.33 | 21.67 | 45 | 3 |
| nonstructural protein NS13 | 1996 | 80.61 | 0 | 28.33 | 16.67 | 41.67 | 13.33 | 45 | 6 |
| nonstructural protein NS14 | 2351 | 81.09 | 0 | 28.33 | 16.67 | 25 | 30 | 45 | 2 |
| anchored capsid protein C | 114 | 82.17 | 0 | 20 | 25 | 46.67 | 8.33 | 45 | 4 |
| anchored capsid protein C | 116 | 82.17 | 0 | 20 | 25 | 46.67 | 8.33 | 45 | 4 |

TABLE 1-continued

| Selected viral probes | | | | | | | | | |
|---|---|---|---|---|---|---|---|---|---|
| anchored capsid protein C | 117 | 82.17 | 0 | 20 | 25 | 46.67 | 8.33 | 45 | 4 |
| anchored capsid protein C | 121 | 82.23 | 0 | 18.33 | 26.67 | 41.67 | 13.33 | 45 | 4 |
| anchored capsid protein C | 138 | 80.98 | 0 | 20 | 25 | 33.33 | 21.67 | 45 | 3 |
| anchored capsid protein C | 139 | 80.13 | 0 | 20 | 23.33 | 35 | 21.67 | 43.33 | 3 |
| anchored capsid protein C | 140 | 79.56 | 0 | 18.33 | 25 | 35 | 21.67 | 43.33 | 3 |
| anchored capsid protein C | 141 | 79.71 | 0 | 20 | 23.33 | 35 | 21.67 | 43.33 | 3 |
| anchored capsid protein C | 142 | 80 | 0 | 20 | 21.67 | 36.67 | 21.67 | 41.67 | 3 |
| anchored capsid protein C | 143 | 80.14 | 0 | 20 | 23.33 | 35 | 21.67 | 43.33 | 3 |
| membrane glycoprotein precursor prM | 85 | 82.64 | 0 | 25 | 20 | 25 | 30 | 45 | 3 |
| membrane glycoprotein precursor prM | 167 | 80.7 | 0 | 25 | 20 | 40 | 15 | 45 | 4 |
| membrane glycoprotein precursor prM | 168 | 80.01 | 0 | 25 | 18.33 | 40 | 16.67 | 43.33 | 4 |
| membrane glycoprotein precursor prM | 169 | 80.01 | 0 | 26.67 | 16.67 | 40 | 16.67 | 43.33 | 4 |
| membrane glycoprotein precursor prM | 170 | 80.7 | 0 | 28.33 | 16.67 | 38.33 | 16.67 | 45 | 4 |
| membrane glycoprotein precursor prM | 171 | 81.21 | 0 | 28.33 | 16.67 | 36.67 | 18.33 | 45 | 4 |
| membrane glycoprotein precursor prM | 172 | 80.8 | 0 | 28.33 | 16.67 | 35 | 20 | 45 | 4 |
| membrane glycoprotein precursor prM | 173 | 80.8 | 0 | 26.67 | 18.33 | 35 | 20 | 45 | 4 |
| membrane glycoprotein precursor prM | 175 | 81.55 | 0 | 26.67 | 18.33 | 35 | 20 | 45 | 4 |
| membrane glycoprotein precursor prM | 182 | 81.69 | 0 | 28.33 | 16.67 | 38.33 | 16.67 | 45 | 4 |
| membrane glycoprotein M | 85 | 82.64 | 0 | 25 | 20 | 25 | 30 | 45 | 3 |
| membrane glycoprotein M | 167 | 80.7 | 0 | 25 | 20 | 40 | 15 | 45 | 4 |
| membrane glycoprotein M | 168 | 80.01 | 0 | 25 | 18.33 | 40 | 16.67 | 43.33 | 4 |
| membrane glycoprotein M | 169 | 80.01 | 0 | 26.67 | 16.67 | 40 | 16.67 | 43.33 | 4 |
| membrane glycoprotein M | 170 | 80.7 | 0 | 28.33 | 16.67 | 38.33 | 16.67 | 45 | 4 |
| membrane glycoprotein M | 171 | 81.21 | 0 | 28.33 | 16.67 | 36.67 | 18.33 | 45 | 4 |
| membrane glycoprotein M | 172 | 80.8 | 0 | 28.33 | 16.67 | 35 | 20 | 45 | 4 |
| membrane glycoprotein M | 173 | 80.8 | 0 | 26.67 | 18.33 | 35 | 20 | 45 | 4 |
| membrane glycoprotein M | 175 | 81.55 | 0 | 26.67 | 18.33 | 35 | 20 | 45 | 4 |
| membrane glycoprotein M | 182 | 81.69 | 0 | 28.33 | 16.67 | 38.33 | 16.67 | 45 | 4 |
| envelope protein E | 180 | 81.01 | 0 | 25 | 20 | 25 | 30 | 45 | 4 |
| envelope protein E | 607 | 81.26 | 0 | 21.67 | 23.33 | 31.67 | 23.33 | 45 | 4 |
| envelope protein E | 679 | 81.49 | 0 | 31.67 | 13.33 | 33.33 | 21.67 | 45 | 3 |
| envelope protein E | 794 | 82 | 0 | 23.33 | 21.67 | 30 | 25 | 45 | 3 |
| envelope protein E | 895 | 81.01 | 0 | 26.67 | 18.33 | 21.67 | 33.33 | 45 | 3 |
| envelope protein E | 1009 | 81.24 | 0 | 25 | 20 | 28.33 | 26.67 | 45 | 3 |

TABLE 1-continued

| Selected viral probes | | | | | | | | |
|---|---|---|---|---|---|---|---|---|
| envelope protein E | 1095 | 81.7 | 0 | 23.33 | 21.67 | 28.33 | 26.67 | 45 | 4 |
| envelope protein E | 1155 | 81.72 | 0 | 23.33 | 21.67 | 33.33 | 21.67 | 45 | 3 |
| envelope protein E | 1369 | 82.3 | 0 | 25 | 20 | 31.67 | 23.33 | 45 | 4 |
| envelope protein E | 1429 | 80.88 | 0 | 25 | 18.33 | 33.33 | 23.33 | 43.33 | 4 |
| nonstructural protein NS1 | 228 | 81.52 | 0 | 21.67 | 23.33 | 31.67 | 23.33 | 45 | 3 |
| nonstructural protein NS1 | 230 | 80.95 | 0 | 21.67 | 23.33 | 33.33 | 21.67 | 45 | 3 |
| nonstructural protein NS1 | 231 | 80.85 | 0 | 23.33 | 21.67 | 33.33 | 21.67 | 45 | 3 |
| nonstructural protein NS1 | 232 | 80.95 | 0 | 23.33 | 21.67 | 31.67 | 23.33 | 45 | 3 |
| nonstructural protein NS1 | 233 | 80.26 | 0 | 21.67 | 21.67 | 31.67 | 25 | 43.33 | 3 |
| nonstructural protein NS1 | 234 | 80.1 | 0 | 20 | 21.67 | 33.33 | 25 | 41.67 | 3 |
| nonstructural protein NS1 | 235 | 79.64 | 0 | 21.67 | 21.67 | 33.33 | 23.33 | 43.33 | 3 |
| nonstructural protein NS1 | 236 | 79.35 | 0 | 20 | 21.67 | 35 | 23.33 | 41.67 | 3 |
| nonstructural protein NS1 | 237 | 78.71 | 0 | 21.67 | 20 | 35 | 23.33 | 41.67 | 3 |
| nonstructural protein NS1 | 238 | 79.27 | 0 | 21.67 | 20 | 35 | 23.33 | 41.67 | 3 |
| nonstructural protein NS2A | 138 | 80.91 | 0 | 20 | 23.33 | 40 | 16.67 | 43.33 | 6 |
| nonstructural protein NS2A | 158 | 80.41 | 0 | 26.67 | 15 | 41.67 | 16.67 | 41.67 | 6 |
| nonstructural protein NS2A | 178 | 79 | 0 | 26.67 | 13.33 | 33.33 | 26.67 | 40 | 6 |
| nonstructural protein NS2A | 198 | 78.54 | 0 | 25 | 13.33 | 26.67 | 35 | 38.33 | 4 |
| nonstructural protein NS2A | 218 | 79.47 | 0 | 20 | 20 | 25 | 35 | 40 | 4 |
| nonstructural protein NS2A | 293 | 80.68 | 0 | 16.67 | 28.33 | 25 | 30 | 45 | 3 |
| nonstructural protein NS2A | 349 | 81.37 | 0 | 25 | 20 | 25 | 30 | 45 | 4 |
| nonstructural protein NS2A | 369 | 81.68 | 0 | 21.67 | 23.33 | 23.33 | 31.67 | 45 | 3 |
| nonstructural protein NS2A | 389 | 81.52 | 0 | 20 | 23.33 | 23.33 | 33.33 | 43.33 | 4 |
| nonstructural protein NS2A | 415 | 82.2 | 0 | 25 | 20 | 23.33 | 31.67 | 45 | 5 |
| nonstructural protein NS2B | 145 | 82.27 | 0 | 26.67 | 18.33 | 30 | 25 | 45 | 4 |
| nonstructural protein NS2B | 146 | 81.44 | 0 | 28.33 | 16.67 | 30 | 25 | 45 | 4 |
| nonstructural protein NS2B | 147 | 81.44 | 0 | 28.33 | 16.67 | 30 | 25 | 45 | 4 |
| nonstructural protein NS2B | 148 | 81.83 | 0 | 26.67 | 16.67 | 30 | 26.67 | 43.33 | 4 |
| nonstructural protein NS2B | 149 | 81.83 | 0 | 26.67 | 16.67 | 31.67 | 25 | 43.33 | 4 |
| nonstructural protein NS2B | 150 | 81.44 | 0 | 28.33 | 16.67 | 30 | 25 | 45 | 4 |
| nonstructural protein NS2B | 151 | 81.25 | 0 | 26.67 | 16.67 | 30 | 26.67 | 43.33 | 4 |
| nonstructural protein NS2B | 152 | 81.16 | 0 | 25 | 16.67 | 31.67 | 26.67 | 41.67 | 4 |
| nonstructural protein NS2B | 153 | 81.48 | 0 | 26.67 | 16.67 | 30 | 26.67 | 43.33 | 4 |
| nonstructural protein NS2B | 154 | 81.99 | 0 | 26.67 | 16.67 | 30 | 26.67 | 43.33 | 4 |
| nonstructural protein NS3 | 60 | 80.56 | 0 | 21.67 | 21.67 | 33.33 | 23.33 | 43.33 | 4 |
| nonstructural protein NS3 | 129 | 80.67 | 0 | 30 | 15 | 36.67 | 18.33 | 45 | 3 |
| nonstructural protein NS3 | 190 | 81.8 | 0 | 21.67 | 23.33 | 31.67 | 23.33 | 45 | 3 |
| nonstructural protein NS3 | 261 | 81.8 | 0 | 20 | 25 | 26.67 | 28.33 | 45 | 3 |
| nonstructural protein NS3 | 421 | 81.85 | 0 | 21.67 | 23.33 | 31.67 | 23.33 | 45 | 3 |

TABLE 1-continued

| Selected viral probes | | | | | | | | | |
|---|---|---|---|---|---|---|---|---|---|
| nonstructural protein NS3 | 646 | 81.8 | 0 | 23.33 | 21.67 | 33.33 | 21.67 | 45 | 4 |
| nonstructural protein NS3 | 708 | 80.26 | 0 | 25 | 20 | 36.67 | 18.33 | 45 | 4 |
| nonstructural protein NS3 | 785 | 81.88 | 0 | 26.67 | 18.33 | 25 | 30 | 45 | 4 |
| nonstructural protein NS3 | 845 | 80.16 | 0 | 28.33 | 16.67 | 35 | 20 | 45 | 3 |
| nonstructural protein NS3 | 1049 | 81.46 | 0 | 15 | 30 | 30 | 25 | 45 | 4 |
| nonstructural protein NS4A | 173 | 80.63 | 0 | 33.33 | 11.67 | 28.33 | 26.67 | 45 | 3 |
| nonstructural protein NS4A | 174 | 80.57 | 0 | 31.67 | 11.67 | 28.33 | 28.33 | 43.33 | 3 |
| nonstructural protein NS4A | 175 | 80.16 | 0 | 31.67 | 11.67 | 26.67 | 30 | 43.33 | 4 |
| nonstructural protein NS4A | 176 | 79.45 | 0 | 30 | 11.67 | 26.67 | 31.67 | 41.67 | 5 |
| nonstructural protein NS4A | 177 | 79.39 | 0 | 28.33 | 11.67 | 26.67 | 33.33 | 40 | 6 |
| nonstructural protein NS4A | 178 | 79.81 | 0 | 30 | 11.67 | 25 | 33.33 | 41.67 | 6 |
| nonstructural protein NS4A | 179 | 80.32 | 0 | 30 | 11.67 | 25 | 33.33 | 41.67 | 6 |
| nonstructural protein NS4A | 180 | 80.02 | 0 | 31.67 | 11.67 | 25 | 31.67 | 43.33 | 6 |
| nonstructural protein NS4A | 181 | 80.49 | 0 | 31.67 | 10 | 25 | 33.33 | 41.67 | 6 |
| nonstructural protein NS4A | 182 | 80.65 | 0 | 33.33 | 10 | 25 | 31.67 | 43.33 | 6 |
| nonstructural protein NS4B | 252 | 81.84 | 0 | 25 | 20 | 26.67 | 28.33 | 45 | 3 |
| nonstructural protein NS4B | 256 | 80.86 | 0 | 26.67 | 18.33 | 28.33 | 26.67 | 45 | 6 |
| nonstructural protein NS4B | 257 | 80.6 | 0 | 26.67 | 16.67 | 30 | 26.67 | 43.33 | 6 |
| nonstructural protein NS4B | 258 | 80.69 | 0 | 26.67 | 16.67 | 30 | 26.67 | 43.33 | 6 |
| nonstructural protein NS4B | 259 | 81.56 | 0 | 28.33 | 16.67 | 30 | 25 | 45 | 6 |
| nonstructural protein NS4B | 260 | 82.07 | 0 | 28.33 | 16.67 | 28.33 | 26.67 | 45 | 6 |
| nonstructural protein NS4B | 261 | 81.53 | 0 | 28.33 | 16.67 | 28.33 | 26.67 | 45 | 6 |
| nonstructural protein NS4B | 262 | 81.63 | 0 | 28.33 | 16.67 | 28.33 | 26.67 | 45 | 6 |
| nonstructural protein NS4B | 263 | 81.53 | 0 | 28.33 | 16.67 | 28.33 | 26.67 | 45 | 6 |
| nonstructural protein NS4B | 264 | 80.96 | 0 | 28.33 | 16.67 | 28.33 | 26.67 | 45 | 6 |
| nonstructural protein NS5 | 60 | 79.85 | 0 | 30 | 15 | 26.67 | 28.33 | 45 | 4 |
| nonstructural protein NS5 | 120 | 78.8 | 0 | 28.33 | 13.33 | 33.33 | 25 | 41.67 | 4 |
| nonstructural protein NS5 | 221 | 81.04 | 0 | 31.67 | 13.33 | 31.67 | 23.33 | 45 | 3 |
| nonstructural protein NS5 | 600 | 81.29 | 0 | 21.67 | 23.33 | 28.33 | 26.67 | 45 | 3 |
| nonstructural protein NS5 | 668 | 81.48 | 0 | 18.33 | 26.67 | 35 | 20 | 45 | 3 |
| nonstructural protein NS5 | 808 | 81.66 | 0 | 31.67 | 13.33 | 35 | 20 | 45 | 5 |
| nonstructural protein NS5 | 1161 | 81.68 | 0 | 28.33 | 16.67 | 33.33 | 21.67 | 45 | 3 |
| nonstructural protein NS5 | 1362 | 81.41 | 0 | 30 | 15 | 40 | 15 | 45 | 3 |
| nonstructural protein NS5 | 1475 | 82.03 | 0 | 28.33 | 16.67 | 35 | 20 | 45 | 4 |
| nonstructural protein NS5 | 1546 | 81.44 | 0 | 26.67 | 18.33 | 33.33 | 21.67 | 45 | 4 |
| gp1-nonstructural polyprotein | 103 | 81.63 | 0 | 20 | 25 | 26.67 | 28.33 | 45 | 3 |
| gp1-nonstructural polyprotein | 164 | 80.48 | 0 | 33.33 | 11.67 | 33.33 | 21.67 | 45 | 3 |

TABLE 1-continued

| Selected viral probes | | | | | | | | | |
|---|---|---|---|---|---|---|---|---|---|
| gp1-nonstructural polyprotein | 260 | 81.9 | 0 | 28.33 | 16.67 | 38.33 | 16.67 | 45 | 5 |
| gp1-nonstructural polyprotein | 338 | 81.53 | 0 | 25 | 20 | 26.67 | 28.33 | 45 | 4 |
| gp1-nonstructural polyprotein | 410 | 81.53 | 0 | 30 | 15 | 33.33 | 21.67 | 45 | 2 |
| gp1-nonstructural polyprotein | 552 | 80.19 | 0 | 13.33 | 30 | 28.33 | 28.33 | 43.33 | 3 |
| gp1-nonstructural polyprotein | 681 | 80.36 | 0 | 30 | 15 | 21.67 | 33.33 | 45 | 4 |
| gp1-nonstructural polyprotein | 741 | 80.26 | 0 | 20 | 21.67 | 28.33 | 30 | 41.67 | 4 |
| gp1-nonstructural polyprotein | 809 | 81.32 | 0 | 18.33 | 26.67 | 26.67 | 28.33 | 45 | 3 |
| gp1-nonstructural polyprotein | 958 | 80.67 | 0 | 26.67 | 18.33 | 36.67 | 18.33 | 45 | 3 |
| gp2-structural polyprotein | 307 | 80.44 | 0 | 25 | 20 | 28.33 | 26.67 | 45 | 3 |
| gp2-structural polyprotein | 372 | 82.09 | 0 | 25 | 20 | 33.33 | 21.67 | 45 | 3 |
| gp2-structural polyprotein | 639 | 81.49 | 0 | 21.67 | 23.33 | 30 | 25 | 45 | 4 |
| gp2-structural polyprotein | 803 | 81.59 | 0 | 21.67 | 23.33 | 30 | 25 | 45 | 4 |
| gp2-structural polyprotein | 933 | 81.13 | 0 | 15 | 30 | 31.67 | 23.33 | 45 | 3 |
| gp2-structural polyprotein | 998 | 82.28 | 0 | 21.67 | 23.33 | 35 | 20 | 45 | 4 |
| gp2-structural polyprotein | 1196 | 81.58 | 0 | 16.67 | 28.33 | 28.33 | 26.67 | 45 | 4 |
| gp2-structural polyprotein | 1389 | 82.61 | 0 | 21.67 | 23.33 | 21.67 | 33.33 | 45 | 6 |
| gp2-structural polyprotein | 1696 | 80.13 | 0 | 21.67 | 23.33 | 18.33 | 36.67 | 45 | 3 |
| gp2-structural polyprotein | 2015 | 82.38 | 0 | 21.67 | 23.33 | 33.33 | 21.67 | 45 | 5 |
| gp3-truncated polyprotein | 116 | 82.61 | 0 | 21.67 | 23.33 | 21.67 | 33.33 | 45 | 6 |
| gp3-truncated polyprotein | 423 | 80.13 | 0 | 21.67 | 23.33 | 18.33 | 36.67 | 45 | 3 |
| gp3-truncated polyprotein | 742 | 82.38 | 0 | 21.67 | 23.33 | 33.33 | 21.67 | 45 | 5 |
| gp3-truncated polyprotein | 844 | 82.49 | 0 | 21.67 | 23.33 | 33.33 | 21.67 | 45 | 5 |
| gp3-truncated polyprotein | 907 | 75.74 | 0 | 25 | 10 | 38.33 | 26.67 | 35 | 3 |
| gp3-truncated polyprotein | 1181 | 79.99 | 0 | 28.33 | 16.67 | 33.33 | 21.67 | 45 | 3 |
| gp3-truncated polyprotein | 1251 | 81.55 | 0 | 20 | 25 | 31.67 | 23.33 | 45 | 3 |
| gp3-truncated polyprotein | 1341 | 81.89 | 0 | 28.33 | 16.67 | 33.33 | 21.67 | 45 | 3 |
| gp3-truncated polyprotein | 1487 | 80.92 | 0 | 16.67 | 28.33 | 33.33 | 21.67 | 45 | 3 |
| gp3-truncated polyprotein | 1576 | 80.51 | 0 | 20 | 25 | 30 | 25 | 45 | 3 |
| anchored capsid protein C | 77 | 80.16 | 0 | 21.67 | 21.67 | 35 | 21.67 | 43.33 | 4 |
| anchored capsid protein C | 107 | 77.96 | 0 | 25 | 11.67 | 41.67 | 21.67 | 36.67 | 4 |
| anchored capsid protein C | 127 | 78.45 | 0 | 25 | 13.33 | 40 | 21.67 | 38.33 | 4 |
| anchored capsid protein C | 150 | 81.44 | 0 | 31.67 | 13.33 | 26.67 | 28.33 | 45 | 4 |
| anchored capsid protein C | 178 | 80.98 | 0 | 21.67 | 21.67 | 31.67 | 25 | 43.33 | 4 |
| anchored capsid protein C | 198 | 78.55 | 0 | 16.67 | 23.33 | 28.33 | 31.67 | 40 | 4 |
| anchored capsid protein C | 218 | 78.65 | 0 | 16.67 | 23.33 | 28.33 | 31.67 | 40 | 4 |

TABLE 1-continued

| Selected viral probes | | | | | | | | |
|---|---|---|---|---|---|---|---|---|
| anchored capsid protein C | 238 | 80.84 | 0 | 25 | 18.33 | 26.67 | 30 | 43.33 | 4 |
| anchored capsid protein C | 262 | 82.4 | 0 | 26.67 | 18.33 | 31.67 | 23.33 | 45 | 4 |
| anchored capsid protein C | 286 | 81.07 | 0 | 25 | 20 | 28.33 | 26.67 | 45 | 4 |
| membrane glycoprotein precursor M | 60 | 81.61 | 0 | 18.33 | 26.67 | 23.33 | 31.67 | 45 | 5 |
| membrane glycoprotein precursor M | 61 | 80.88 | 0 | 18.33 | 25 | 25 | 31.67 | 43.33 | 5 |
| membrane glycoprotein precursor M | 62 | 80.15 | 0 | 18.33 | 25 | 25 | 31.67 | 43.33 | 5 |
| membrane glycoprotein precursor M | 63 | 79.96 | 0 | 16.67 | 25 | 26.67 | 31.67 | 41.67 | 5 |
| membrane glycoprotein precursor M | 64 | 79.82 | 0 | 15 | 25 | 28.33 | 31.67 | 40 | 5 |
| membrane glycoprotein precursor M | 65 | 79.89 | 0 | 16.67 | 25 | 28.33 | 30 | 41.67 | 5 |
| membrane glycoprotein precursor M | 66 | 80.09 | 0 | 18.33 | 25 | 26.67 | 30 | 43.33 | 5 |
| membrane glycoprotein precursor M | 67 | 79.82 | 0 | 18.33 | 23.33 | 28.33 | 30 | 41.67 | 5 |
| membrane glycoprotein precursor M | 68 | 79.49 | 0 | 18.33 | 21.67 | 28.33 | 31.67 | 40 | 5 |
| membrane glycoprotein precursor M | 69 | 79.49 | 0 | 18.33 | 21.67 | 30 | 30 | 40 | 5 |
| envelope protein E | 105 | 80.9 | 0 | 21.67 | 23.33 | 26.67 | 28.33 | 45 | 3 |
| envelope protein E | 167 | 81.01 | 0 | 33.33 | 11.67 | 21.67 | 33.33 | 45 | 4 |
| envelope protein E | 323 | 81.49 | 0 | 30 | 15 | 35 | 20 | 45 | 4 |
| envelope protein E | 404 | 81.47 | 0 | 26.67 | 18.33 | 33.33 | 21.67 | 45 | 5 |
| envelope protein E | 532 | 80.95 | 0 | 20 | 25 | 31.67 | 23.33 | 45 | 4 |
| envelope protein E | 594 | 81.36 | 0 | 28.33 | 16.67 | 31.67 | 23.33 | 45 | 3 |
| envelope protein E | 666 | 77.48 | 0 | 20 | 15 | 41.67 | 23.33 | 35 | 5 |
| envelope protein E | 752 | 81.12 | 0 | 26.67 | 18.33 | 40 | 15 | 45 | 6 |
| envelope protein E | 812 | 79.51 | 0 | 20 | 23.33 | 35 | 21.67 | 43.33 | 3 |
| envelope protein E | 936 | 77.28 | 0 | 25 | 11.67 | 35 | 28.33 | 36.67 | 6 |
| nonstructural protein NS1 | 60 | 80.02 | 0 | 26.67 | 16.67 | 38.33 | 18.33 | 43.33 | 3 |
| nonstructural protein NS1 | 160 | 81.26 | 0 | 20 | 25 | 35 | 20 | 45 | 3 |
| nonstructural protein NS1 | 220 | 80.04 | 0 | 28.33 | 15 | 26.67 | 30 | 43.33 | 3 |
| nonstructural protein NS1 | 280 | 80.92 | 0 | 23.33 | 18.33 | 30 | 28.33 | 41.67 | 4 |
| nonstructural protein NS1 | 340 | 78.4 | 0 | 20 | 21.67 | 40 | 18.33 | 41.67 | 3 |
| nonstructural protein NS1 | 401 | 81.84 | 0 | 21.67 | 23.33 | 35 | 20 | 45 | 4 |
| nonstructural protein NS1 | 461 | 79.88 | 0 | 30 | 15 | 35 | 20 | 45 | 4 |
| nonstructural protein NS1 | 561 | 81.72 | 0 | 21.67 | 23.33 | 28.33 | 26.67 | 45 | 3 |
| nonstructural protein NS1 | 621 | 79.19 | 0 | 25 | 13.33 | 36.67 | 25 | 38.33 | 4 |
| nonstructural protein NS1 | 698 | 81.74 | 0 | 16.67 | 28.33 | 40 | 15 | 45 | 4 |
| nonstructural protein NS2A | 63 | 78.19 | 0 | 18.33 | 20 | 36.67 | 25 | 38.33 | 4 |

TABLE 1-continued

| Selected viral probes | | | | | | | | | |
|---|---|---|---|---|---|---|---|---|---|
| nonstructural protein NS2A | 138 | 79.52 | 0 | 10 | 30 | 25 | 35 | 40 | 6 |
| nonstructural protein NS2A | 178 | 78.48 | 0 | 16.67 | 23.33 | 25 | 35 | 40 | 3 |
| nonstructural protein NS2A | 218 | 79.02 | 0 | 16.67 | 21.67 | 25 | 36.67 | 38.33 | 5 |
| nonstructural protein NS2A | 258 | 78.42 | 0 | 18.33 | 20 | 23.33 | 38.33 | 38.33 | 4 |
| nonstructural protein NS2A | 298 | 80.78 | 0 | 31.67 | 13.33 | 28.33 | 26.67 | 45 | 4 |
| nonstructural protein NS2A | 346 | 79.96 | 0 | 25 | 18.33 | 25 | 31.67 | 43.33 | 3 |
| nonstructural protein NS2A | 386 | 77.34 | 0 | 21.67 | 18.33 | 23.33 | 36.67 | 40 | 3 |
| nonstructural protein NS2A | 524 | 80.68 | 0 | 28.33 | 16.67 | 30 | 25 | 45 | 3 |
| nonstructural protein NS2A | 569 | 80.86 | 0 | 23.33 | 20 | 28.33 | 28.33 | 43.33 | 5 |
| nonstructural protein NS2B | 60 | 80.85 | 0 | 23.33 | 20 | 31.67 | 25 | 43.33 | 5 |
| nonstructural protein NS2B | 61 | 81.14 | 0 | 23.33 | 21.67 | 30 | 25 | 45 | 5 |
| nonstructural protein NS2B | 62 | 81.59 | 0 | 21.67 | 21.67 | 31.67 | 25 | 43.33 | 5 |
| nonstructural protein NS2B | 63 | 80.89 | 0 | 21.67 | 21.67 | 30 | 26.67 | 43.33 | 5 |
| nonstructural protein NS2B | 64 | 80.81 | 0 | 20 | 21.67 | 31.67 | 26.67 | 41.67 | 5 |
| nonstructural protein NS2B | 65 | 80.02 | 0 | 20 | 21.67 | 30 | 28.33 | 41.67 | 5 |
| nonstructural protein NS2B | 66 | 80.02 | 0 | 21.67 | 20 | 30 | 28.33 | 41.67 | 5 |
| nonstructural protein NS2B | 67 | 80.72 | 0 | 23.33 | 20 | 28.33 | 28.33 | 43.33 | 5 |
| nonstructural protein NS2B | 68 | 81.42 | 0 | 25 | 20 | 26.67 | 28.33 | 45 | 5 |
| nonstructural protein NS2B | 70 | 82.09 | 0 | 25 | 20 | 26.67 | 28.33 | 45 | 5 |
| nonstructural protein NS3 | 383 | 80.94 | 0 | 15 | 30 | 35 | 20 | 45 | 5 |
| nonstructural protein NS3 | 443 | 80.76 | 0 | 23.33 | 21.67 | 35 | 20 | 45 | 3 |
| nonstructural protein NS3 | 645 | 81.42 | 0 | 23.33 | 21.67 | 35 | 20 | 45 | 3 |
| nonstructural protein NS3 | 705 | 77.27 | 0 | 18.33 | 18.33 | 46.67 | 16.67 | 36.67 | 6 |
| nonstructural protein NS3 | 765 | 80.34 | 0 | 26.67 | 15 | 38.33 | 20 | 41.67 | 3 |
| nonstructural protein NS3 | 825 | 81.37 | 0 | 23.33 | 21.67 | 25 | 30 | 45 | 4 |
| nonstructural protein NS3 | 885 | 80.25 | 0 | 21.67 | 21.67 | 36.67 | 20 | 43.33 | 3 |
| nonstructural protein NS3 | 1013 | 81.43 | 0 | 21.67 | 23.33 | 30 | 25 | 45 | 4 |
| nonstructural protein NS3 | 1073 | 80.31 | 0 | 16.67 | 28.33 | 21.67 | 33.33 | 45 | 3 |
| nonstructural protein NS3 | 1133 | 80.39 | 0 | 30 | 15 | 36.67 | 18.33 | 45 | 3 |
| nonstructural protein NS4A | 80 | 80.8 | 0 | 21.67 | 23.33 | 18.33 | 36.67 | 45 | 4 |
| nonstructural protein NS4A | 151 | 81.8 | 0 | 21.67 | 23.33 | 25 | 30 | 45 | 5 |
| nonstructural protein NS4A | 174 | 81.34 | 0 | 23.33 | 21.67 | 23.33 | 31.67 | 45 | 5 |
| nonstructural protein NS4A | 228 | 80.81 | 0 | 28.33 | 16.67 | 21.67 | 33.33 | 45 | 3 |
| nonstructural protein NS4A | 248 | 80.32 | 0 | 21.67 | 21.67 | 31.67 | 25 | 43.33 | 3 |
| nonstructural protein NS4A | 269 | 80.12 | 0 | 18.33 | 26.67 | 40 | 15 | 45 | 4 |
| nonstructural protein NS4A | 296 | 80.09 | 0 | 21.67 | 21.67 | 38.33 | 18.33 | 43.33 | 4 |
| nonstructural protein NS4A | 316 | 80.57 | 0 | 25 | 20 | 33.33 | 21.67 | 45 | 4 |
| nonstructural protein NS4A | 359 | 81.64 | 0 | 20 | 25 | 38.33 | 16.67 | 45 | 3 |
| nonstructural protein NS4A | 379 | 78.87 | 0 | 20 | 21.67 | 36.67 | 21.67 | 41.67 | 3 |

TABLE 1-continued

| Selected viral probes | | | | | | | | |
|---|---|---|---|---|---|---|---|---|
| nonstructural protein NS4B | 63 | 79.97 | 0 | 30 | 15 | 26.67 | 28.33 | 45 | 4 |
| nonstructural protein NS4B | 114 | 80.33 | 0 | 23.33 | 18.33 | 31.67 | 26.67 | 41.67 | 5 |
| nonstructural protein NS4B | 242 | 81.11 | 0 | 18.33 | 25 | 28.33 | 28.33 | 43.33 | 3 |
| nonstructural protein NS4B | 282 | 79.24 | 0 | 23.33 | 15 | 31.67 | 30 | 38.33 | 5 |
| nonstructural protein NS4B | 324 | 80.65 | 0 | 23.33 | 20 | 30 | 26.67 | 43.33 | 5 |
| nonstructural protein NS4B | 365 | 79.43 | 0 | 20 | 21.67 | 48.33 | 10 | 41.67 | 6 |
| nonstructural protein NS4B | 412 | 81.34 | 0 | 23.33 | 21.67 | 30 | 25 | 45 | 4 |
| nonstructural protein NS4B | 524 | 79.92 | 0 | 26.67 | 16.67 | 31.67 | 25 | 43.33 | 3 |
| nonstructural protein NS4B | 564 | 80.18 | 0 | 21.67 | 21.67 | 31.67 | 25 | 43.33 | 3 |
| nonstructural protein NS4B | 604 | 79.98 | 0 | 13.33 | 28.33 | 38.33 | 20 | 41.67 | 4 |
| nonstructural protein NS5 | 61 | 80.76 | 0 | 25 | 20 | 36.67 | 18.33 | 45 | 5 |
| nonstructural protein NS5 | 121 | 79.62 | 0 | 21.67 | 20 | 38.33 | 20 | 41.67 | 3 |
| nonstructural protein NS5 | 190 | 80.76 | 0 | 26.67 | 18.33 | 35 | 20 | 45 | 5 |
| nonstructural protein NS5 | 273 | 81.21 | 0 | 33.33 | 11.67 | 31.67 | 23.33 | 45 | 4 |
| nonstructural protein NS5 | 422 | 81.23 | 0 | 26.67 | 18.33 | 28.33 | 26.67 | 45 | 3 |
| nonstructural protein NS5 | 596 | 82.36 | 0 | 21.67 | 23.33 | 26.67 | 28.33 | 45 | 3 |
| nonstructural protein NS5 | 656 | 79.94 | 0 | 28.33 | 13.33 | 43.33 | 15 | 41.67 | 4 |
| nonstructural protein NS5 | 716 | 80.73 | 0 | 25 | 18.33 | 31.67 | 25 | 43.33 | 3 |
| nonstructural protein NS5 | 779 | 82.27 | 0 | 26.67 | 18.33 | 40 | 15 | 45 | 6 |
| nonstructural protein NS5 | 841 | 81.36 | 0 | 21.67 | 23.33 | 35 | 20 | 45 | 4 |
| anchored capsid protein C | 62 | 80.98 | 0 | 26.67 | 18.33 | 28.33 | 26.67 | 45 | 2 |
| anchored capsid protein C | 63 | 80.25 | 0 | 25 | 18.33 | 30 | 26.67 | 43.33 | 2 |
| anchored capsid protein C | 64 | 80.25 | 0 | 23.33 | 20 | 30 | 26.67 | 43.33 | 2 |
| anchored capsid protein C | 65 | 80.78 | 0 | 23.33 | 20 | 31.67 | 25 | 43.33 | 2 |
| anchored capsid protein C | 66 | 80.38 | 0 | 23.33 | 20 | 31.67 | 25 | 43.33 | 2 |
| anchored capsid protein C | 67 | 80.28 | 0 | 23.33 | 20 | 31.67 | 25 | 43.33 | 2 |
| anchored capsid protein C | 68 | 80.28 | 0 | 23.33 | 20 | 31.67 | 25 | 43.33 | 2 |
| anchored capsid protein C | 69 | 80.28 | 0 | 21.67 | 21.67 | 31.67 | 25 | 43.33 | 2 |
| anchored capsid protein C | 70 | 80.62 | 0 | 23.33 | 21.67 | 30 | 25 | 45 | 2 |
| anchored capsid protein C | 71 | 80.99 | 0 | 23.33 | 20 | 30 | 26.67 | 43.33 | 2 |
| membrane glycoprotein precursor M | 60 | 80.14 | 0 | 11.67 | 30 | 28.33 | 30 | 41.67 | 4 |
| membrane glycoprotein precursor M | 80 | 80.21 | 0 | 16.67 | 26.67 | 31.67 | 25 | 43.33 | 4 |
| membrane glycoprotein precursor M | 133 | 82.19 | 0 | 21.67 | 23.33 | 30 | 25 | 45 | 3 |
| membrane glycoprotein precursor M | 165 | 81.49 | 0 | 25 | 20 | 33.33 | 21.67 | 45 | 4 |
| membrane glycoprotein precursor M | 185 | 81.32 | 0 | 26.67 | 18.33 | 38.33 | 16.67 | 45 | 4 |
| membrane glycoprotein precursor M | 245 | 81.44 | 0 | 30 | 15 | 38.33 | 16.67 | 45 | 6 |

TABLE 1-continued

Selected viral probes

| | | | | | | | | |
|---|---|---|---|---|---|---|---|---|
| membrane glycoprotein precursor M | 270 | 81.21 | 0 | 28.33 | 16.67 | 36.67 | 18.33 | 45 | 6 |
| membrane glycoprotein precursor M | 439 | 81.29 | 0 | 26.67 | 18.33 | 30 | 25 | 45 | 4 |
| membrane glycoprotein precursor M | 459 | 79.83 | 0 | 30 | 13.33 | 38.33 | 18.33 | 43.33 | 4 |
| membrane glycoprotein precursor M | 479 | 80.03 | 0 | 23.33 | 18.33 | 41.67 | 16.67 | 41.67 | 4 |
| envelope protein E | 64 | 81.37 | 0 | 31.67 | 13.33 | 21.67 | 33.33 | 45 | 3 |
| envelope protein E | 124 | 78.25 | 0 | 18.33 | 21.67 | 35 | 25 | 40 | 4 |
| envelope protein E | 200 | 81.06 | 0 | 20 | 25 | 26.67 | 28.33 | 45 | 3 |
| envelope protein E | 300 | 82.18 | 0 | 30 | 15 | 31.67 | 23.33 | 45 | 6 |
| envelope protein E | 360 | 80.89 | 0 | 26.67 | 18.33 | 36.67 | 18.33 | 45 | 3 |
| envelope protein E | 420 | 80.32 | 0 | 20 | 25 | 40 | 15 | 45 | 5 |
| envelope protein E | 480 | 77.43 | 0 | 21.67 | 16.67 | 31.67 | 30 | 38.33 | 6 |
| envelope protein E | 540 | 80.4 | 0 | 25 | 20 | 35 | 20 | 45 | 4 |
| envelope protein E | 600 | 77.18 | 0 | 25 | 11.67 | 40 | 23.33 | 36.67 | 3 |
| envelope protein E | 660 | 81.36 | 0 | 20 | 25 | 35 | 20 | 45 | 3 |
| nonstructural protein NS1 | 60 | 80.06 | 0 | 25 | 16.67 | 36.67 | 21.67 | 41.67 | 3 |
| nonstructural protein NS1 | 141 | 81.62 | 0 | 20 | 25 | 33.33 | 21.67 | 45 | 3 |
| nonstructural protein NS1 | 230 | 80.58 | 0 | 31.67 | 13.33 | 30 | 25 | 45 | 3 |
| nonstructural protein NS1 | 290 | 80.38 | 0 | 23.33 | 21.67 | 36.67 | 18.33 | 45 | 3 |
| nonstructural protein NS1 | 350 | 79.7 | 0 | 20 | 21.67 | 35 | 23.33 | 41.67 | 3 |
| nonstructural protein NS1 | 410 | 81.28 | 0 | 18.33 | 26.67 | 33.33 | 21.67 | 45 | 5 |
| nonstructural protein NS1 | 470 | 79.06 | 0 | 26.67 | 15 | 36.67 | 21.67 | 41.67 | 3 |
| nonstructural protein NS1 | 537 | 81.45 | 0 | 20 | 25 | 38.33 | 16.67 | 45 | 4 |
| nonstructural protein NS1 | 597 | 76.37 | 0 | 21.67 | 13.33 | 38.33 | 26.67 | 35 | 4 |
| nonstructural protein NS1 | 695 | 80.24 | 0 | 15 | 30 | 31.67 | 23.33 | 45 | 5 |
| nonstructural protein NS2A | 105 | 79.5 | 0 | 15 | 25 | 38.33 | 21.67 | 40 | 6 |
| nonstructural protein NS2A | 147 | 82.33 | 0 | 15 | 30 | 30 | 25 | 45 | 6 |
| nonstructural protein NS2A | 187 | 80.48 | 0 | 26.67 | 15 | 35 | 23.33 | 41.67 | 4 |
| nonstructural protein NS2A | 227 | 80.44 | 0 | 20 | 21.67 | 30 | 28.33 | 41.67 | 3 |
| nonstructural protein NS2A | 267 | 78.32 | 0 | 26.67 | 13.33 | 35 | 25 | 40 | 4 |
| nonstructural protein NS2A | 309 | 81.33 | 0 | 23.33 | 21.67 | 26.67 | 28.33 | 45 | 3 |
| nonstructural protein NS2A | 349 | 79.47 | 0 | 16.67 | 28.33 | 30 | 25 | 45 | 3 |
| nonstructural protein NS2A | 389 | 77.78 | 0 | 23.33 | 18.33 | 31.67 | 26.67 | 41.67 | 3 |
| nonstructural protein NS2A | 436 | 81.39 | 0 | 15 | 30 | 23.33 | 31.67 | 45 | 4 |
| nonstructural protein NS2A | 536 | 80.56 | 0 | 31.67 | 13.33 | 26.67 | 28.33 | 45 | 3 |
| nonstructural protein NS2B | 63 | 81.92 | 0 | 23.33 | 21.67 | 33.33 | 21.67 | 45 | 3 |
| nonstructural protein NS2B | 64 | 81.92 | 0 | 23.33 | 21.67 | 31.67 | 23.33 | 45 | 4 |
| nonstructural protein NS2B | 65 | 81.41 | 0 | 23.33 | 21.67 | 30 | 25 | 45 | 5 |

TABLE 1-continued

| Selected viral probes | | | | | | | | | |
|---|---|---|---|---|---|---|---|---|---|
| nonstructural protein NS2B | 66 | 81.34 | 0 | 23.33 | 21.67 | 30 | 25 | 45 | 5 |
| nonstructural protein NS2B | 67 | 81.85 | 0 | 23.33 | 21.67 | 30 | 25 | 45 | 5 |
| nonstructural protein NS2B | 85 | 81.85 | 0 | 21.67 | 23.33 | 25 | 30 | 45 | 5 |
| nonstructural protein NS2B | 93 | 81.68 | 0 | 21.67 | 23.33 | 28.33 | 26.67 | 45 | 5 |
| nonstructural protein NS2B | 94 | 80.89 | 0 | 21.67 | 23.33 | 26.67 | 28.33 | 45 | 5 |
| nonstructural protein NS2B | 95 | 80.04 | 0 | 21.67 | 21.67 | 26.67 | 30 | 43.33 | 5 |
| nonstructural protein NS2B | 96 | 79.95 | 0 | 20 | 21.67 | 28.33 | 30 | 41.67 | 5 |
| nonstructural protein NS3 | 60 | 80.58 | 0 | 25 | 18.33 | 35 | 21.67 | 43.33 | 4 |
| nonstructural protein NS3 | 120 | 80.15 | 0 | 31.67 | 10 | 40 | 18.33 | 41.67 | 4 |
| nonstructural protein NS3 | 180 | 79.61 | 0 | 28.33 | 13.33 | 40 | 18.33 | 41.67 | 4 |
| nonstructural protein NS3 | 265 | 79.93 | 0 | 26.67 | 18.33 | 31.67 | 23.33 | 45 | 4 |
| nonstructural protein NS3 | 346 | 82.18 | 0 | 26.67 | 18.33 | 31.67 | 23.33 | 45 | 4 |
| nonstructural protein NS3 | 406 | 81.01 | 0 | 21.67 | 23.33 | 40 | 15 | 45 | 4 |
| nonstructural protein NS3 | 466 | 77.78 | 0 | 21.67 | 15 | 45 | 18.33 | 36.67 | 6 |
| nonstructural protein NS3 | 609 | 81.33 | 0 | 21.67 | 23.33 | 35 | 20 | 45 | 4 |
| nonstructural protein NS3 | 669 | 80.44 | 0 | 25 | 18.33 | 31.67 | 25 | 43.33 | 3 |
| nonstructural protein NS3 | 729 | 76.54 | 0 | 25 | 11.67 | 40 | 23.33 | 36.67 | 5 |
| nonstructural protein NS4A | 70 | 76.19 | 0 | 16.67 | 18.33 | 26.67 | 38.33 | 35 | 6 |
| nonstructural protein NS4A | 71 | 76.49 | 0 | 18.33 | 18.33 | 25 | 38.33 | 36.67 | 6 |
| nonstructural protein NS4A | 72 | 76.83 | 0 | 16.67 | 18.33 | 25 | 40 | 35 | 6 |
| nonstructural protein NS4A | 73 | 76.49 | 0 | 16.67 | 20 | 25 | 38.33 | 36.67 | 6 |
| nonstructural protein NS4A | 74 | 76.29 | 0 | 16.67 | 18.33 | 26.67 | 38.33 | 35 | 6 |
| nonstructural protein NS4A | 75 | 76.29 | 0 | 16.67 | 18.33 | 26.67 | 38.33 | 35 | 6 |
| nonstructural protein NS4A | 76 | 76.77 | 0 | 16.67 | 18.33 | 26.67 | 38.33 | 35 | 6 |
| nonstructural protein NS4A | 77 | 76.54 | 0 | 16.67 | 20 | 25 | 38.33 | 36.67 | 6 |
| nonstructural protein NS4A | 78 | 77.15 | 0 | 15 | 21.67 | 25 | 38.33 | 36.67 | 6 |
| nonstructural protein NS4A | 79 | 77.52 | 0 | 16.67 | 21.67 | 23.33 | 38.33 | 38.33 | 6 |
| nonstructural protein NS4B | 63 | 79.89 | 0 | 18.33 | 23.33 | 31.67 | 26.67 | 41.67 | 4 |
| nonstructural protein NS4B | 113 | 80.07 | 0 | 28.33 | 15 | 23.33 | 33.33 | 43.33 | 5 |
| nonstructural protein NS4B | 213 | 80.39 | 0 | 28.33 | 16.67 | 23.33 | 31.67 | 45 | 3 |
| nonstructural protein NS4B | 254 | 80.55 | 0 | 25 | 18.33 | 28.33 | 28.33 | 43.33 | 4 |
| nonstructural protein NS4B | 294 | 78.5 | 0 | 20 | 18.33 | 36.67 | 25 | 38.33 | 4 |
| nonstructural protein NS4B | 413 | 81.51 | 0 | 18.33 | 25 | 31.67 | 25 | 43.33 | 4 |
| nonstructural protein NS4B | 458 | 79.87 | 0 | 15 | 28.33 | 25 | 31.67 | 43.33 | 4 |
| nonstructural protein NS4B | 577 | 80.18 | 0 | 16.67 | 25 | 33.33 | 25 | 41.67 | 4 |
| nonstructural protein NS4B | 617 | 78.77 | 0 | 18.33 | 20 | 33.33 | 28.33 | 38.33 | 4 |
| nonstructural protein NS4B | 739 | 81.65 | 0 | 26.67 | 18.33 | 36.67 | 18.33 | 45 | 6 |
| RNA-dependent RNA pol. NS5 | 60 | 79.36 | 0 | 30 | 13.33 | 38.33 | 18.33 | 43.33 | 4 |

TABLE 1-continued

Selected viral probes

| | | | | | | | | |
|---|---|---|---|---|---|---|---|---|
| RNA-dependent RNA pol. NS5 | 120 | 76.91 | 0 | 15 | 20 | 46.67 | 18.33 | 35 | 3 |
| RNA-dependent RNA pol. NS5 | 196 | 81.55 | 0 | 28.33 | 16.67 | 33.33 | 21.67 | 45 | 4 |
| RNA-dependent RNA pol. NS5 | 261 | 81.5 | 0 | 28.33 | 16.67 | 38.33 | 16.67 | 45 | 4 |
| RNA-dependent RNA pol. NS5 | 322 | 81.11 | 0 | 23.33 | 21.67 | 35 | 20 | 45 | 3 |
| RNA-dependent RNA pol. NS5 | 549 | 81.62 | 0 | 26.67 | 18.33 | 31.67 | 23.33 | 45 | 3 |
| RNA-dependent RNA pol. NS5 | 609 | 80.4 | 0 | 21.67 | 21.67 | 28.33 | 28.33 | 43.33 | 3 |
| RNA-dependent RNA pol. NS5 | 669 | 77.57 | 0 | 20 | 16.67 | 43.33 | 20 | 36.67 | 3 |
| RNA-dependent RNA pol. NS5 | 732 | 81.46 | 0 | 30 | 15 | 28.33 | 26.67 | 45 | 3 |
| RNA-dependent RNA pol. NS5 | 807 | 81.59 | 0 | 25 | 20 | 36.67 | 18.33 | 45 | 4 |
| anchored capsid protein C | 60 | 82.23 | 0 | 18.33 | 26.67 | 31.67 | 23.33 | 45 | 5 |
| anchored capsid protein C | 61 | 81.79 | 0 | 18.33 | 26.67 | 33.33 | 21.67 | 45 | 5 |
| anchored capsid protein C | 62 | 80.67 | 0 | 18.33 | 25 | 33.33 | 23.33 | 43.33 | 5 |
| anchored capsid protein C | 63 | 80.51 | 0 | 16.67 | 25 | 35 | 23.33 | 41.67 | 5 |
| anchored capsid protein C | 64 | 80.64 | 0 | 16.67 | 26.67 | 35 | 21.67 | 43.33 | 5 |
| anchored capsid protein C | 65 | 81.05 | 0 | 18.33 | 26.67 | 35 | 20 | 45 | 5 |
| anchored capsid protein C | 66 | 81.36 | 0 | 18.33 | 25 | 36.67 | 20 | 43.33 | 5 |
| anchored capsid protein C | 67 | 80.89 | 0 | 20 | 25 | 35 | 20 | 45 | 5 |
| anchored capsid protein C | 68 | 80.55 | 0 | 20 | 23.33 | 35 | 21.67 | 43.33 | 5 |
| anchored capsid protein C | 69 | 80.55 | 0 | 18.33 | 25 | 35 | 21.67 | 43.33 | 5 |
| membrane glycoprotein precursor M | 60 | 80.72 | 0 | 16.67 | 26.67 | 25 | 31.67 | 43.33 | 4 |
| membrane glycoprotein precursor M | 61 | 80.2 | 0 | 16.67 | 26.67 | 23.33 | 33.33 | 43.33 | 4 |
| membrane glycoprotein precursor M | 62 | 80.13 | 0 | 16.67 | 26.67 | 23.33 | 33.33 | 43.33 | 4 |
| membrane glycoprotein precursor M | 63 | 80.23 | 0 | 16.67 | 26.67 | 23.33 | 33.33 | 43.33 | 4 |
| membrane glycoprotein precursor M | 64 | 80.23 | 0 | 15 | 28.33 | 23.33 | 33.33 | 43.33 | 4 |
| membrane glycoprotein precursor M | 65 | 81.12 | 0 | 16.67 | 28.33 | 23.33 | 31.67 | 45 | 4 |
| membrane glycoprotein precursor M | 67 | 81.05 | 0 | 18.33 | 26.67 | 23.33 | 31.67 | 45 | 4 |
| membrane glycoprotein precursor M | 68 | 80.73 | 0 | 18.33 | 25 | 23.33 | 33.33 | 43.33 | 4 |
| membrane glycoprotein precursor M | 69 | 80.73 | 0 | 18.33 | 25 | 25 | 31.67 | 43.33 | 4 |
| membrane glycoprotein precursor M | 70 | 80.35 | 0 | 18.33 | 26.67 | 23.33 | 31.67 | 45 | 4 |

TABLE 1-continued

| Selected viral probes | | | | | | | | |
|---|---|---|---|---|---|---|---|---|
| envelope protein E | 60 | 79.96 | 0 | 21.67 | 20 | 25 | 33.33 | 41.67 | 4 |
| envelope protein E | 121 | 77.5 | 0 | 21.67 | 15 | 35 | 28.33 | 36.67 | 6 |
| envelope protein E | 184 | 81.88 | 0 | 26.67 | 18.33 | 23.33 | 31.67 | 45 | 3 |
| envelope protein E | 343 | 81.88 | 0 | 30 | 15 | 36.67 | 18.33 | 45 | 4 |
| envelope protein E | 403 | 80.4 | 0 | 30 | 15 | 28.33 | 26.67 | 45 | 4 |
| envelope protein E | 486 | 81.55 | 0 | 23.33 | 21.67 | 35 | 20 | 45 | 4 |
| envelope protein E | 554 | 80.83 | 0 | 28.33 | 16.67 | 38.33 | 16.67 | 45 | 4 |
| envelope protein E | 614 | 80.1 | 0 | 28.33 | 13.33 | 33.33 | 25 | 41.67 | 4 |
| envelope protein E | 675 | 81.01 | 0 | 25 | 20 | 35 | 20 | 45 | 4 |
| envelope protein E | 761 | 82.39 | 0 | 26.67 | 18.33 | 38.33 | 16.67 | 45 | 6 |
| nonstructural protein NS1 | 60 | 78.87 | 0 | 25 | 16.67 | 38.33 | 20 | 41.67 | 3 |
| nonstructural protein NS1 | 178 | 81.3 | 0 | 28.33 | 16.67 | 35 | 20 | 45 | 3 |
| nonstructural protein NS1 | 241 | 81.09 | 0 | 26.67 | 18.33 | 31.67 | 23.33 | 45 | 3 |
| nonstructural protein NS1 | 346 | 79.82 | 0 | 18.33 | 26.67 | 35 | 20 | 45 | 3 |
| nonstructural protein NS1 | 406 | 81.24 | 0 | 20 | 25 | 33.33 | 21.67 | 45 | 5 |
| nonstructural protein NS1 | 466 | 80.52 | 0 | 26.67 | 16.67 | 40 | 16.67 | 43.33 | 5 |
| nonstructural protein NS1 | 565 | 81.04 | 0 | 18.33 | 26.67 | 35 | 20 | 45 | 3 |
| nonstructural protein NS1 | 677 | 82.15 | 0 | 16.67 | 28.33 | 35 | 20 | 45 | 4 |
| nonstructural protein NS1 | 737 | 80.86 | 0 | 26.67 | 16.67 | 41.67 | 15 | 43.33 | 5 |
| nonstructural protein NS1 | 801 | 81.32 | 0 | 30 | 15 | 33.33 | 21.67 | 45 | 4 |
| nonstructural protein NS2A | 63 | 79.26 | 0 | 16.67 | 25 | 26.67 | 31.67 | 41.67 | 5 |
| nonstructural protein NS2A | 144 | 82.49 | 0 | 25 | 20 | 25 | 30 | 45 | 4 |
| nonstructural protein NS2A | 192 | 82.44 | 0 | 21.67 | 23.33 | 25 | 30 | 45 | 5 |
| nonstructural protein NS2A | 232 | 78.41 | 0 | 15 | 21.67 | 30 | 33.33 | 36.67 | 5 |
| nonstructural protein NS2A | 272 | 80.03 | 0 | 21.67 | 21.67 | 30 | 26.67 | 43.33 | 4 |
| nonstructural protein NS2A | 354 | 81.71 | 0 | 26.67 | 16.67 | 28.33 | 28.33 | 43.33 | 3 |
| nonstructural protein NS2A | 395 | 76.4 | 0 | 25 | 10 | 28.33 | 36.67 | 35 | 5 |
| nonstructural protein NS2A | 435 | 78.21 | 0 | 13.33 | 23.33 | 25 | 38.33 | 36.67 | 5 |
| nonstructural protein NS2A | 538 | 81.23 | 0 | 21.67 | 23.33 | 30 | 25 | 45 | 3 |
| nonstructural protein NS2A | 579 | 80.06 | 0 | 21.67 | 18.33 | 23.33 | 36.67 | 40 | 4 |
| nonstructural protein NS2B | 66 | 81.62 | 0 | 13.33 | 30 | 30 | 26.67 | 43.33 | 5 |
| nonstructural protein NS2B | 67 | 81.05 | 0 | 13.33 | 30 | 30 | 26.67 | 43.33 | 5 |
| nonstructural protein NS2B | 68 | 81.76 | 0 | 15 | 28.33 | 30 | 26.67 | 43.33 | 5 |
| nonstructural protein NS2B | 69 | 82.46 | 0 | 16.67 | 28.33 | 28.33 | 26.67 | 45 | 5 |
| nonstructural protein NS2B | 70 | 82.91 | 0 | 16.67 | 28.33 | 28.33 | 26.67 | 45 | 5 |
| nonstructural protein NS2B | 72 | 82.81 | 0 | 16.67 | 28.33 | 26.67 | 28.33 | 45 | 5 |
| nonstructural protein NS2B | 73 | 82.78 | 0 | 16.67 | 28.33 | 26.67 | 28.33 | 45 | 5 |
| nonstructural protein NS2B | 74 | 82.5 | 0 | 16.67 | 28.33 | 25 | 30 | 45 | 5 |
| nonstructural protein NS2B | 78 | 81.4 | 0 | 18.33 | 26.67 | 23.33 | 31.67 | 45 | 5 |

TABLE 1-continued

| Selected viral probes | | | | | | | | | |
|---|---|---|---|---|---|---|---|---|---|
| nonstructural protein NS2B | 79 | 80.7 | 0 | 16.67 | 26.67 | 25 | 31.67 | 43.33 | 5 |
| nonstructural protein NS3 | 91 | 81.61 | 0 | 21.67 | 23.33 | 30 | 25 | 45 | 6 |
| nonstructural protein NS3 | 160 | 79.32 | 0 | 28.33 | 10 | 40 | 21.67 | 38.33 | 4 |
| nonstructural protein NS3 | 220 | 77.1 | 0 | 21.67 | 15 | 41.67 | 21.67 | 36.67 | 4 |
| nonstructural protein NS3 | 365 | 80.49 | 0 | 21.67 | 23.33 | 38.33 | 16.67 | 45 | 3 |
| nonstructural protein NS3 | 456 | 81.65 | 0 | 20 | 25 | 36.67 | 18.33 | 45 | 3 |
| nonstructural protein NS3 | 598 | 80.54 | 0 | 25 | 20 | 36.67 | 18.33 | 45 | 3 |
| nonstructural protein NS3 | 658 | 80.82 | 0 | 28.33 | 15 | 30 | 26.67 | 43.33 | 5 |
| nonstructural protein NS3 | 721 | 75.78 | 0 | 20 | 15 | 43.33 | 21.67 | 35 | 6 |
| nonstructural protein NS3 | 781 | 81.42 | 0 | 25 | 18.33 | 33.33 | 23.33 | 43.33 | 6 |
| nonstructural protein NS3 | 842 | 82.06 | 0 | 23.33 | 21.67 | 35 | 20 | 45 | 4 |
| nonstructural protein NS4A | 60 | 79.18 | 0 | 25 | 16.67 | 30 | 28.33 | 41.67 | 6 |
| nonstructural protein NS4A | 61 | 79.47 | 0 | 26.67 | 16.67 | 28.33 | 28.33 | 43.33 | 6 |
| nonstructural protein NS4A | 62 | 80.12 | 0 | 25 | 18.33 | 28.33 | 28.33 | 43.33 | 6 |
| nonstructural protein NS4A | 63 | 80.12 | 0 | 25 | 18.33 | 26.67 | 30 | 43.33 | 6 |
| nonstructural protein NS4A | 64 | 80.19 | 0 | 25 | 18.33 | 26.67 | 30 | 43.33 | 6 |
| nonstructural protein NS4A | 65 | 80.4 | 0 | 25 | 20 | 25 | 30 | 45 | 6 |
| nonstructural protein NS4A | 66 | 80.4 | 0 | 26.67 | 18.33 | 25 | 30 | 45 | 6 |
| nonstructural protein NS4A | 67 | 81.04 | 0 | 25 | 20 | 25 | 30 | 45 | 6 |
| nonstructural protein NS4A | 68 | 81.45 | 0 | 25 | 20 | 23.33 | 31.67 | 45 | 6 |
| nonstructural protein NS4A | 69 | 81.42 | 0 | 25 | 20 | 23.33 | 31.67 | 45 | 6 |
| nonstructural protein NS4B | 60 | 78.06 | 0 | 25 | 11.67 | 31.67 | 31.67 | 36.67 | 5 |
| nonstructural protein NS4B | 124 | 81.1 | 0 | 23.33 | 21.67 | 26.67 | 28.33 | 45 | 5 |
| nonstructural protein NS4B | 186 | 81.35 | 0 | 21.67 | 23.33 | 30 | 25 | 45 | 3 |
| nonstructural protein NS4B | 253 | 82.36 | 0 | 23.33 | 21.67 | 25 | 30 | 45 | 5 |
| nonstructural protein NS4B | 319 | 75.02 | 0 | 21.67 | 13.33 | 36.67 | 28.33 | 35 | 3 |
| nonstructural protein NS4B | 395 | 82.01 | 0 | 23.33 | 21.67 | 36.67 | 18.33 | 45 | 4 |
| nonstructural protein NS4B | 455 | 80.53 | 0 | 16.67 | 28.33 | 26.67 | 28.33 | 45 | 4 |
| nonstructural protein NS4B | 537 | 82.23 | 0 | 28.33 | 16.67 | 33.33 | 21.67 | 45 | 5 |
| nonstructural protein NS4B | 597 | 79.33 | 0 | 18.33 | 25 | 33.33 | 23.33 | 43.33 | 3 |
| nonstructural protein NS4B | 708 | 80.91 | 0 | 28.33 | 16.67 | 21.67 | 33.33 | 45 | 3 |
| nonstructural protein NS5 | 75 | 80.29 | 0 | 30 | 15 | 35 | 20 | 45 | 2 |
| nonstructural protein NS5 | 185 | 80.9 | 0 | 25 | 20 | 31.67 | 23.33 | 45 | 3 |
| nonstructural protein NS5 | 245 | 78.2 | 0 | 20 | 18.33 | 40 | 21.67 | 38.33 | 4 |
| nonstructural protein NS5 | 311 | 81.46 | 0 | 25 | 20 | 26.67 | 28.33 | 45 | 3 |
| nonstructural protein NS5 | 401 | 81.03 | 0 | 16.67 | 28.33 | 31.67 | 23.33 | 45 | 2 |
| nonstructural protein NS5 | 503 | 81.02 | 0 | 28.33 | 16.67 | 38.33 | 16.67 | 45 | 3 |
| nonstructural protein NS5 | 564 | 81.38 | 0 | 26.67 | 18.33 | 30 | 25 | 45 | 4 |
| nonstructural protein NS5 | 653 | 82.17 | 0 | 28.33 | 16.67 | 35 | 20 | 45 | 3 |

TABLE 1-continued

| Selected viral probes | | | | | | | | | |
|---|---|---|---|---|---|---|---|---|---|
| nonstructural protein NS5 | 738 | 81.85 | 0 | 30 | 15 | 31.67 | 23.33 | 45 | 5 |
| nonstructural protein NS5 | 798 | 80.9 | 0 | 26.67 | 18.33 | 40 | 15 | 45 | 4 |
| anchored capsid protein C | 62 | 81.5 | 0 | 25 | 20 | 30 | 25 | 45 | 5 |
| anchored capsid protein C | 63 | 80.77 | 0 | 23.33 | 20 | 31.67 | 25 | 43.33 | 5 |
| anchored capsid protein C | 64 | 80.77 | 0 | 21.67 | 21.67 | 31.67 | 25 | 43.33 | 5 |
| anchored capsid protein C | 65 | 81.31 | 0 | 21.67 | 21.67 | 33.33 | 23.33 | 43.33 | 5 |
| anchored capsid protein C | 66 | 81.31 | 0 | 21.67 | 21.67 | 33.33 | 23.33 | 43.33 | 5 |
| anchored capsid protein C | 67 | 81.62 | 0 | 23.33 | 21.67 | 31.67 | 23.33 | 45 | 5 |
| anchored capsid protein C | 68 | 81.61 | 0 | 23.33 | 21.67 | 31.67 | 23.33 | 45 | 5 |
| anchored capsid protein C | 69 | 80.97 | 0 | 21.67 | 23.33 | 31.67 | 23.33 | 45 | 5 |
| anchored capsid protein C | 70 | 81.12 | 0 | 23.33 | 21.67 | 31.67 | 23.33 | 45 | 5 |
| anchored capsid protein C | 71 | 81.5 | 0 | 23.33 | 20 | 31.67 | 25 | 43.33 | 5 |
| membrane glycoprotein precursor M | 77 | 79.82 | 0 | 23.33 | 20 | 25 | 31.67 | 43.33 | 3 |
| membrane glycoprotein precursor M | 97 | 81.54 | 0 | 26.67 | 18.33 | 25 | 30 | 45 | 3 |
| membrane glycoprotein precursor M | 119 | 81.97 | 0 | 25 | 20 | 26.67 | 28.33 | 45 | 3 |
| membrane glycoprotein precursor M | 218 | 80.6 | 0 | 26.67 | 18.33 | 33.33 | 21.67 | 45 | 3 |
| membrane glycoprotein precursor M | 240 | 81.5 | 0 | 26.67 | 18.33 | 38.33 | 16.67 | 45 | 3 |
| membrane glycoprotein precursor M | 359 | 81.47 | 0 | 16.67 | 28.33 | 30 | 25 | 45 | 5 |
| membrane glycoprotein precursor M | 403 | 81.3 | 0 | 25 | 20 | 28.33 | 26.67 | 45 | 3 |
| membrane glycoprotein precursor M | 426 | 80.83 | 0 | 25 | 18.33 | 33.33 | 23.33 | 43.33 | 4 |
| membrane glycoprotein precursor M | 449 | 81.32 | 0 | 25 | 20 | 35 | 20 | 45 | 5 |
| membrane glycoprotein precursor M | 473 | 80.95 | 0 | 23.33 | 21.67 | 35 | 20 | 45 | 5 |
| envelope protein E | 81 | 81.58 | 0 | 25 | 20 | 26.67 | 28.33 | 45 | 3 |
| envelope protein E | 141 | 80.03 | 0 | 33.33 | 11.67 | 21.67 | 33.33 | 45 | 3 |
| envelope protein E | 201 | 80.98 | 0 | 25 | 16.67 | 25 | 33.33 | 41.67 | 5 |
| envelope protein E | 270 | 82.36 | 0 | 28.33 | 16.67 | 26.67 | 28.33 | 45 | 4 |
| envelope protein E | 330 | 81.57 | 0 | 25 | 20 | 28.33 | 26.67 | 45 | 3 |
| envelope protein E | 390 | 80.71 | 0 | 25 | 20 | 33.33 | 21.67 | 45 | 6 |
| envelope protein E | 460 | 82.09 | 0 | 21.67 | 23.33 | 33.33 | 21.67 | 45 | 5 |
| envelope protein E | 520 | 80.11 | 0 | 30 | 15 | 33.33 | 21.67 | 45 | 4 |
| envelope protein E | 580 | 80.85 | 0 | 26.67 | 15 | 38.33 | 20 | 41.67 | 4 |
| envelope protein E | 640 | 78.53 | 0 | 26.67 | 13.33 | 35 | 25 | 40 | 3 |
| non-structural protein NS1 | 64 | 80.92 | 0 | 31.67 | 13.33 | 36.67 | 18.33 | 45 | 5 |
| non-structural protein NS1 | 234 | 81.36 | 0 | 25 | 20 | 35 | 20 | 45 | 4 |

TABLE 1-continued

| Selected viral probes | | | | | | | | | |
|---|---|---|---|---|---|---|---|---|---|
| non-structural protein NS1 | 347 | 82.19 | 0 | 16.67 | 28.33 | 30 | 25 | 45 | 5 |
| non-structural protein NS1 | 419 | 81.84 | 0 | 21.67 | 23.33 | 33.33 | 21.67 | 45 | 4 |
| non-structural protein NS1 | 487 | 81.23 | 0 | 26.67 | 18.33 | 33.33 | 21.67 | 45 | 6 |
| non-structural protein NS1 | 547 | 80.05 | 0 | 26.67 | 15 | 35 | 23.33 | 41.67 | 3 |
| non-structural protein NS1 | 607 | 80.03 | 0 | 26.67 | 16.67 | 30 | 26.67 | 43.33 | 3 |
| non-structural protein NS1 | 667 | 81.13 | 0 | 20 | 25 | 35 | 20 | 45 | 5 |
| non-structural protein NS1 | 727 | 79.15 | 0 | 20 | 18.33 | 45 | 16.67 | 38.33 | 5 |
| non-structural protein NS1 | 848 | 80.26 | 0 | 25 | 20 | 33.33 | 21.67 | 45 | 3 |
| non-structural protein NS2A | 79 | 80.84 | 0 | 16.67 | 28.33 | 31.67 | 23.33 | 45 | 3 |
| non-structural protein NS2A | 119 | 80.42 | 0 | 20 | 23.33 | 33.33 | 23.33 | 43.33 | 5 |
| non-structural protein NS2A | 159 | 82.34 | 0 | 23.33 | 21.67 | 16.67 | 38.33 | 45 | 3 |
| non-structural protein NS2A | 199 | 80.91 | 0 | 25 | 16.67 | 23.33 | 35 | 41.67 | 3 |
| non-structural protein NS2A | 239 | 79.77 | 0 | 15 | 26.67 | 30 | 28.33 | 41.67 | 3 |
| non-structural protein NS2A | 279 | 77.78 | 0 | 18.33 | 18.33 | 38.33 | 25 | 36.67 | 5 |
| non-structural protein NS2A | 319 | 77.31 | 0 | 16.67 | 20 | 28.33 | 35 | 36.67 | 4 |
| non-structural protein NS2A | 359 | 81.43 | 0 | 21.67 | 23.33 | 33.33 | 21.67 | 45 | 3 |
| non-structural protein NS2A | 399 | 78.89 | 0 | 25 | 15 | 31.67 | 28.33 | 40 | 5 |
| non-structural protein NS2A | 565 | 80.72 | 0 | 23.33 | 21.67 | 21.67 | 33.33 | 45 | 3 |
| non-structural protein NS2B | 60 | 80.94 | 0 | 20 | 23.33 | 35 | 21.67 | 43.33 | 4 |
| non-structural protein NS2B | 61 | 81.23 | 0 | 20 | 25 | 33.33 | 21.67 | 45 | 4 |
| non-structural protein NS2B | 62 | 81.69 | 0 | 18.33 | 25 | 35 | 21.67 | 43.33 | 4 |
| non-structural protein NS2B | 63 | 81.4 | 0 | 18.33 | 25 | 33.33 | 23.33 | 43.33 | 4 |
| non-structural protein NS2B | 64 | 81.46 | 0 | 18.33 | 26.67 | 31.67 | 23.33 | 45 | 4 |
| non-structural protein NS2B | 65 | 81.36 | 0 | 18.33 | 26.67 | 30 | 25 | 45 | 4 |
| non-structural protein NS2B | 66 | 81.29 | 0 | 18.33 | 26.67 | 30 | 25 | 45 | 4 |
| non-structural protein NS2B | 67 | 81.2 | 0 | 18.33 | 26.67 | 28.33 | 26.67 | 45 | 4 |
| non-structural protein NS2B | 68 | 81.2 | 0 | 20 | 25 | 28.33 | 26.67 | 45 | 4 |
| non-structural protein NS2B | 80 | 81.14 | 0 | 18.33 | 26.67 | 25 | 30 | 45 | 4 |
| non-structural protein NS3 | 75 | 81.8 | 0 | 28.33 | 16.67 | 25 | 30 | 45 | 4 |
| non-structural protein NS3 | 176 | 78.8 | 0 | 30 | 10 | 40 | 20 | 40 | 4 |
| non-structural protein NS3 | 264 | 80.87 | 0 | 33.33 | 11.67 | 28.33 | 26.67 | 45 | 4 |
| non-structural protein NS3 | 342 | 82.25 | 0 | 25 | 20 | 31.67 | 23.33 | 45 | 6 |
| non-structural protein NS3 | 413 | 81.19 | 0 | 20 | 25 | 35 | 20 | 45 | 3 |
| non-structural protein NS3 | 645 | 81.26 | 0 | 30 | 15 | 28.33 | 26.67 | 45 | 5 |
| non-structural protein NS3 | 705 | 79.28 | 0 | 23.33 | 20 | 38.33 | 18.33 | 43.33 | 5 |
| non-structural protein NS3 | 767 | 78.17 | 0 | 25 | 11.67 | 41.67 | 21.67 | 36.67 | 4 |
| non-structural protein NS3 | 828 | 81.6 | 0 | 28.33 | 16.67 | 30 | 25 | 45 | 4 |
| non-structural protein NS3 | 1015 | 80.76 | 0 | 25 | 20 | 26.67 | 28.33 | 45 | 3 |
| non-structural protein NS4A | 60 | 76.92 | 0 | 18.33 | 18.33 | 35 | 28.33 | 36.67 | 6 |

TABLE 1-continued

| Selected viral probes | | | | | | | | |
|---|---|---|---|---|---|---|---|---|
| non-structural protein NS4A | 61 | 76.3 | 0 | 16.67 | 20 | 35 | 28.33 | 36.67 | 6 |
| non-structural protein NS4A | 62 | 76.92 | 0 | 15 | 21.67 | 35 | 28.33 | 36.67 | 6 |
| non-structural protein NS4A | 63 | 77.77 | 0 | 16.67 | 21.67 | 33.33 | 28.33 | 38.33 | 6 |
| non-structural protein NS4A | 64 | 78.47 | 0 | 18.33 | 21.67 | 31.67 | 28.33 | 40 | 6 |
| non-structural protein NS4A | 65 | 78.69 | 0 | 18.33 | 23.33 | 30 | 28.33 | 41.67 | 6 |
| non-structural protein NS4A | 66 | 79.4 | 0 | 20 | 21.67 | 30 | 28.33 | 41.67 | 6 |
| non-structural protein NS4A | 67 | 79.82 | 0 | 20 | 21.67 | 30 | 28.33 | 41.67 | 6 |
| non-structural protein NS4A | 68 | 79.54 | 0 | 20 | 21.67 | 28.33 | 30 | 41.67 | 6 |
| non-structural protein NS4A | 69 | 79.51 | 0 | 20 | 21.67 | 28.33 | 30 | 41.67 | 6 |
| non-structural protein NS4B | 79 | 81.5 | 0 | 26.67 | 18.33 | 26.67 | 28.33 | 45 | 5 |
| non-structural protein NS4B | 200 | 81.85 | 0 | 23.33 | 21.67 | 25 | 30 | 45 | 3 |
| non-structural protein NS4B | 230 | 80.7 | 0 | 25 | 20 | 21.67 | 33.33 | 45 | 3 |
| non-structural protein NS4B | 261 | 79.88 | 0 | 23.33 | 18.33 | 31.67 | 26.67 | 41.67 | 4 |
| non-structural protein NS4B | 291 | 76.31 | 0 | 18.33 | 18.33 | 40 | 23.33 | 36.67 | 4 |
| non-structural protein NS4B | 322 | 76.94 | 0 | 18.33 | 20 | 41.67 | 20 | 38.33 | 5 |
| non-structural protein NS4B | 410 | 81.05 | 0 | 21.67 | 21.67 | 33.33 | 23.33 | 43.33 | 4 |
| non-structural protein NS4B | 440 | 78.06 | 0 | 13.33 | 25 | 31.67 | 30 | 38.33 | 4 |
| non-structural protein NS4B | 699 | 81.8 | 0 | 21.67 | 23.33 | 30 | 25 | 45 | 5 |
| non-structural protein NS4B | 729 | 78.65 | 0 | 23.33 | 13.33 | 41.67 | 21.67 | 36.67 | 6 |
| non-structural protein NS5 | 60 | 79.06 | 0 | 28.33 | 15 | 31.67 | 25 | 43.33 | 4 |
| non-structural protein NS5 | 191 | 80.9 | 0 | 26.67 | 18.33 | 23.33 | 31.67 | 45 | 4 |
| non-structural protein NS5 | 251 | 79.7 | 0 | 23.33 | 20 | 35 | 21.67 | 43.33 | 3 |
| non-structural protein NS5 | 322 | 81.8 | 0 | 18.33 | 26.67 | 35 | 20 | 45 | 3 |
| non-structural protein NS5 | 548 | 81.03 | 0 | 28.33 | 16.67 | 30 | 25 | 45 | 3 |
| non-structural protein NS5 | 608 | 81.4 | 0 | 20 | 25 | 28.33 | 26.67 | 45 | 5 |
| non-structural protein NS5 | 776 | 80.94 | 0 | 35 | 8.33 | 36.67 | 20 | 43.33 | 3 |
| non-structural protein NS5 | 836 | 80.84 | 0 | 26.67 | 16.67 | 43.33 | 13.33 | 43.33 | 4 |
| non-structural protein NS5 | 896 | 80.34 | 0 | 18.33 | 25 | 33.33 | 23.33 | 43.33 | 3 |
| non-structural protein NS5 | 999 | 81.94 | 0 | 18.33 | 26.67 | 36.67 | 18.33 | 45 | 4 |
| polyprotein precursor | 418 | 81.82 | 0 | 20 | 25 | 28.33 | 26.67 | 45 | 3 |
| polyprotein precursor | 837 | 81.13 | 0 | 26.67 | 18.33 | 28.33 | 26.67 | 45 | 5 |
| polyprotein precursor | 1318 | 81.07 | 0 | 23.33 | 21.67 | 26.67 | 28.33 | 45 | 5 |
| polyprotein precursor | 1619 | 80.79 | 0 | 25 | 20 | 23.33 | 31.67 | 45 | 3 |
| polyprotein precursor | 1733 | 81.81 | 0 | 25 | 20 | 23.33 | 31.67 | 45 | 3 |
| polyprotein precursor | 1985 | 81.93 | 0 | 20 | 25 | 26.67 | 28.33 | 45 | 4 |
| polyprotein precursor | 2759 | 81.52 | 0 | 21.67 | 23.33 | 28.33 | 26.67 | 45 | 3 |
| polyprotein precursor | 3072 | 81.18 | 0 | 21.67 | 23.33 | 25 | 30 | 45 | 3 |
| polyprotein precursor | 3135 | 81.21 | 0 | 18.33 | 26.67 | 23.33 | 31.67 | 45 | 2 |
| polyprotein precursor | 4680 | 80.5 | 0 | 30 | 15 | 26.67 | 28.33 | 45 | 4 |

TABLE 1-continued

| Selected viral probes | | | | | | | | | |
|---|---|---|---|---|---|---|---|---|---|
| putative E1 protein | 536 | 80.9 | 0 | 26.67 | 18.33 | 25 | 30 | 45 | 3 |
| putative E1 protein | 60 | 85.53 | 0 | 33.33 | 21.67 | 18.33 | 26.67 | 55 | 3 |
| putative E1 protein | 117 | 86.53 | 0 | 28.33 | 26.67 | 10 | 35 | 55 | 4 |
| putative E1 protein | 157 | 85.28 | 0 | 23.33 | 31.67 | 20 | 25 | 55 | 5 |
| putative E1 protein | 202 | 86.76 | 0 | 28.33 | 26.67 | 25 | 20 | 55 | 4 |
| putative E1 protein | 298 | 86.37 | 0 | 38.33 | 16.67 | 16.67 | 28.33 | 55 | 5 |
| putative E1 protein | 344 | 86.91 | 0 | 30 | 25 | 15 | 30 | 55 | 5 |
| putative E1 protein | 437 | 86.26 | 0 | 35 | 20 | 16.67 | 28.33 | 55 | 3 |
| putative E1 protein | 480 | 87.8 | 0 | 28.33 | 26.67 | 15 | 30 | 55 | 5 |
| putative E1 protein | 576 | 80.9 | 0 | 28.33 | 18.33 | 28.33 | 25 | 46.67 | 4 |
| putative E2 protein | 60 | 86.63 | 0 | 33.33 | 21.67 | 15 | 30 | 55 | 4 |
| putative E2 protein | 90 | 84.02 | 0 | 30 | 20 | 20 | 30 | 50 | 4 |
| putative E2 protein | 120 | 84.81 | 0 | 33.33 | 20 | 15 | 31.67 | 53.33 | 3 |
| putative E2 protein | 266 | 86.43 | 0 | 31.67 | 23.33 | 15 | 30 | 55 | 3 |
| putative E2 protein | 296 | 82.71 | 0 | 30 | 18.33 | 15 | 36.67 | 48.33 | 3 |
| putative E2 protein | 326 | 87.29 | 0 | 23.33 | 31.67 | 11.67 | 33.33 | 55 | 5 |
| putative E2 protein | 364 | 86.06 | 0 | 30 | 25 | 20 | 25 | 55 | 3 |
| putative E2 protein | 394 | 85.42 | 0 | 30 | 23.33 | 15 | 31.67 | 53.33 | 3 |
| putative E2 protein | 435 | 86.32 | 0 | 33.33 | 21.67 | 15 | 30 | 55 | 4 |
| putative E2 protein | 627 | 85.74 | 0 | 23.33 | 31.67 | 25 | 20 | 55 | 3 |
| putative protein p7-NS2 | 60 | 85.27 | 0 | 26.67 | 28.33 | 13.33 | 31.67 | 55 | 3 |
| putative protein p7-NS2 | 166 | 85.18 | 0 | 28.33 | 26.67 | 18.33 | 26.67 | 55 | 3 |
| putative protein p7-NS2 | 196 | 84.7 | 0 | 26.67 | 26.67 | 20 | 26.67 | 53.33 | 3 |
| putative protein p7-NS2 | 228 | 87.2 | 0 | 33.33 | 21.67 | 16.67 | 28.33 | 55 | 5 |
| putative protein p7-NS2 | 258 | 82.78 | 0 | 31.67 | 16.67 | 16.67 | 35 | 48.33 | 5 |
| putative protein p7-NS2 | 288 | 85.07 | 0 | 28.33 | 25 | 20 | 26.67 | 53.33 | 3 |
| putative protein p7-NS2 | 410 | 86.51 | 0 | 35 | 20 | 8.33 | 36.67 | 55 | 3 |
| putative protein p7-NS2 | 440 | 86.19 | 0 | 33.33 | 21.67 | 8.33 | 36.67 | 55 | 3 |
| putative protein p7-NS2 | 474 | 86.96 | 0 | 33.33 | 21.67 | 11.67 | 33.33 | 55 | 3 |
| putative protein p7-NS2 | 566 | 85.08 | 0 | 38.33 | 16.67 | 25 | 20 | 55 | 4 |
| NS3 proteinase/ ATPase/helicase | 711 | 80.5 | 0 | 30 | 15 | 26.67 | 28.33 | 45 | 4 |
| NS3 proteinase/ ATPase/helicase | 717 | 80.82 | 0 | 30 | 15 | 25 | 30 | 45 | 4 |
| NS3 proteinase/ ATPase/helicase | 723 | 80.66 | 0 | 28.33 | 16.67 | 28.33 | 26.67 | 45 | 4 |
| NS3 proteinase/ ATPase/helicase | 724 | 80.66 | 0 | 26.67 | 18.33 | 28.33 | 26.67 | 45 | 4 |
| NS3 proteinase/ ATPase/helicase | 725 | 80.56 | 0 | 26.67 | 18.33 | 28.33 | 26.67 | 45 | 4 |
| NS3 proteinase/ ATPase/helicase | 726 | 79.99 | 0 | 26.67 | 18.33 | 28.33 | 26.67 | 45 | 4 |

TABLE 1-continued

| Selected viral probes | | | | | | | | | |
|---|---|---|---|---|---|---|---|---|---|
| NS3 proteinase/ ATPase/helicase | 727 | 80.56 | 0 | 26.67 | 18.33 | 28.33 | 26.67 | 45 | 4 |
| NS3 proteinase/ ATPase/helicase | 733 | 80.43 | 0 | 30 | 15 | 28.33 | 26.67 | 45 | 6 |
| NS3 proteinase/ ATPase/helicase | 734 | 79.79 | 0 | 28.33 | 16.67 | 28.33 | 26.67 | 45 | 6 |
| NS3 proteinase/ ATPase/helicase | 735 | 80.52 | 0 | 28.33 | 16.67 | 28.33 | 26.67 | 45 | 6 |
| putative NS4A protein | 154 | 85.13 | 0 | 36.67 | 18.33 | 23.33 | 21.67 | 55 | 3 |
| putative NS4A protein | 155 | 84.45 | 0 | 36.67 | 18.33 | 23.33 | 21.67 | 55 | 3 |
| putative NS4A protein | 156 | 84.45 | 0 | 36.67 | 18.33 | 23.33 | 21.67 | 55 | 3 |
| putative NS4A protein | 157 | 85.11 | 0 | 36.67 | 18.33 | 23.33 | 21.67 | 55 | 3 |
| putative NS4A protein | 183 | 85.51 | 0 | 31.67 | 23.33 | 20 | 25 | 55 | 6 |
| putative NS4A protein | 186 | 84.95 | 0 | 31.67 | 23.33 | 20 | 25 | 55 | 6 |
| putative NS4A protein | 187 | 84.28 | 0 | 31.67 | 23.33 | 20 | 25 | 55 | 6 |
| putative NS4A protein | 188 | 84.95 | 0 | 31.67 | 23.33 | 20 | 25 | 55 | 6 |
| putative NS4A protein | 193 | 85.09 | 0 | 31.67 | 23.33 | 20 | 25 | 55 | 6 |
| putative NS4A protein | 194 | 85.03 | 0 | 31.67 | 23.33 | 20 | 25 | 55 | 6 |
| putative NS4B protein | 144 | 81.18 | 0 | 21.67 | 23.33 | 25 | 30 | 45 | 3 |
| putative NS4B protein | 145 | 80.68 | 0 | 21.67 | 23.33 | 25 | 30 | 45 | 3 |
| putative NS4B protein | 146 | 80.77 | 0 | 21.67 | 23.33 | 25 | 30 | 45 | 3 |
| putative NS4B protein | 148 | 81.51 | 0 | 21.67 | 23.33 | 26.67 | 28.33 | 45 | 3 |
| putative NS4B protein | 149 | 80.72 | 0 | 21.67 | 23.33 | 26.67 | 28.33 | 45 | 3 |
| putative NS4B protein | 150 | 80.02 | 0 | 20 | 23.33 | 26.67 | 30 | 43.33 | 3 |
| putative NS4B protein | 151 | 80.1 | 0 | 20 | 23.33 | 26.67 | 30 | 43.33 | 3 |
| putative NS4B protein | 152 | 80.8 | 0 | 20 | 25 | 25 | 30 | 45 | 3 |
| putative NS4B protein | 153 | 80.8 | 0 | 20 | 25 | 25 | 30 | 45 | 3 |
| putative NS4B protein | 154 | 80.39 | 0 | 20 | 23.33 | 25 | 31.67 | 43.33 | 3 |
| putative NS5A protein | 63 | 81.64 | 0 | 30 | 15 | 28.33 | 26.67 | 45 | 3 |
| putative NS5A protein | 64 | 81.57 | 0 | 28.33 | 16.67 | 28.33 | 26.67 | 45 | 3 |
| putative NS5A protein | 82 | 82.61 | 0 | 33.33 | 11.67 | 23.33 | 31.67 | 45 | 3 |
| putative NS5A protein | 83 | 82.19 | 0 | 33.33 | 11.67 | 21.67 | 33.33 | 45 | 3 |
| putative NS5A protein | 84 | 82.12 | 0 | 31.67 | 13.33 | 21.67 | 33.33 | 45 | 3 |
| putative NS5A protein | 293 | 81.93 | 0 | 20 | 25 | 26.67 | 28.33 | 45 | 4 |
| putative NS5A protein | 296 | 81.15 | 0 | 21.67 | 23.33 | 26.67 | 28.33 | 45 | 4 |
| putative NS5A protein | 297 | 80.48 | 0 | 21.67 | 23.33 | 26.67 | 28.33 | 45 | 4 |
| putative NS5A protein | 298 | 81.04 | 0 | 23.33 | 21.67 | 26.67 | 28.33 | 45 | 4 |
| putative NS5A protein | 301 | 80.92 | 0 | 25 | 20 | 26.67 | 28.33 | 45 | 4 |
| putative NS5B RNA- dependent RNA pol. | 415 | 81.82 | 0 | 20 | 25 | 28.33 | 26.67 | 45 | 3 |

TABLE 1-continued

| Selected viral probes | | | | | | | | |
|---|---|---|---|---|---|---|---|---|
| putative NS5B RNA-dependent RNA pol. | 416 | 81.85 | 0 | 20 | 25 | 28.33 | 26.67 | 45 | 3 |
| putative NS5B RNA-dependent RNA pol. | 834 | 81.13 | 0 | 26.67 | 18.33 | 28.33 | 26.67 | 45 | 5 |
| putative NS5B RNA-dependent RNA pol. | 1315 | 81.07 | 0 | 23.33 | 21.67 | 26.67 | 28.33 | 45 | 5 |
| putative NS5B RNA-dependent RNA pol. | 1316 | 80.37 | 0 | 23.33 | 21.67 | 25 | 30 | 45 | 5 |
| putative NS5B RNA-dependent RNA pol. | 1317 | 80.28 | 0 | 21.67 | 21.67 | 26.67 | 30 | 43.33 | 5 |
| putative NS5B RNA-dependent RNA pol. | 1318 | 80.32 | 0 | 23.33 | 21.67 | 25 | 30 | 45 | 5 |
| putative NS5B RNA-dependent RNA pol. | 1319 | 80.76 | 0 | 23.33 | 21.67 | 25 | 30 | 45 | 5 |
| putative NS5B RNA-dependent RNA pol. | 1616 | 80.79 | 0 | 25 | 20 | 23.33 | 31.67 | 45 | 3 |
| putative NS5B RNA-dependent RNA pol. | 1617 | 80.23 | 0 | 25 | 20 | 23.33 | 31.67 | 45 | 3 |
| 1A VP4b mature peptide | 68 | 81.03 | 0 | 23.33 | 21.67 | 23.33 | 31.67 | 45 | 4 |
| 1A VP4b mature peptide | 115 | 75.84 | 0 | 18.33 | 16.67 | 30 | 35 | 35 | 5 |
| 1A VP4b mature peptide | 238 | 80.5 | 0 | 21.67 | 21.67 | 23.33 | 33.33 | 43.33 | 3 |
| 1A VP4b mature peptide | 293 | 81.47 | 0 | 26.67 | 18.33 | 20 | 35 | 45 | 3 |
| 1A VP4b mature peptide | 340 | 80.79 | 0 | 21.67 | 21.67 | 31.67 | 25 | 43.33 | 5 |
| 1A VP4b mature peptide | 380 | 80.48 | 0 | 33.33 | 11.67 | 26.67 | 28.33 | 45 | 3 |
| 1A VP4b mature peptide | 428 | 80.46 | 0 | 25 | 20 | 28.33 | 26.67 | 45 | 4 |
| 1A VP4b mature peptide | 468 | 80.54 | 0 | 21.67 | 23.33 | 20 | 35 | 45 | 4 |
| 1A VP4b mature peptide | 520 | 81.35 | 0 | 30 | 15 | 28.33 | 26.67 | 45 | 4 |
| 1A VP4b mature peptide | 647 | 77.38 | 0 | 16.67 | 21.67 | 21.67 | 40 | 38.33 | 5 |
| 1B VP2 mature peptide | 61 | 76.15 | 0 | 16.67 | 18.33 | 26.67 | 38.33 | 35 | 4 |
| 1B VP2 mature peptide | 121 | 75.88 | 0 | 20 | 15 | 33.33 | 31.67 | 35 | 3 |
| 1B VP2 mature peptide | 181 | 77.16 | 0 | 15 | 20 | 33.33 | 31.67 | 35 | 3 |
| 1B VP2 mature peptide | 270 | 76.51 | 0 | 18.33 | 16.67 | 25 | 40 | 35 | 3 |
| 1B VP2 mature peptide | 338 | 80.84 | 0 | 21.67 | 23.33 | 25 | 30 | 45 | 6 |
| 1B VP2 mature peptide | 398 | 79.36 | 0 | 25 | 13.33 | 30 | 31.67 | 38.33 | 3 |
| 1B VP2 mature peptide | 464 | 77.13 | 0 | 20 | 15 | 28.33 | 36.67 | 35 | 4 |
| 1B VP2 mature peptide | 524 | 77.9 | 0 | 20 | 16.67 | 33.33 | 30 | 36.67 | 5 |
| 1B VP2 mature peptide | 585 | 81.32 | 0 | 21.67 | 23.33 | 23.33 | 31.67 | 45 | 3 |
| 1B VP2 mature peptide | 645 | 78.29 | 0 | 21.67 | 16.67 | 23.33 | 38.33 | 38.33 | 4 |
| 1C VP3 mature peptide | 60 | 77.07 | 0 | 15 | 20 | 26.67 | 38.33 | 35 | 4 |

TABLE 1-continued

| Selected viral probes | | | | | | | | | |
|---|---|---|---|---|---|---|---|---|---|
| 1C VP3 mature peptide | 120 | 77.83 | 0 | 15 | 23.33 | 23.33 | 38.33 | 38.33 | 3 |
| 1C VP3 mature peptide | 180 | 80.34 | 0 | 25 | 16.67 | 31.67 | 26.67 | 41.67 | 3 |
| 1C VP3 mature peptide | 240 | 79.49 | 0 | 20 | 21.67 | 23.33 | 35 | 41.67 | 3 |
| 1C VP3 mature peptide | 300 | 79.56 | 0 | 21.67 | 20 | 33.33 | 25 | 41.67 | 3 |
| 1C VP3 mature peptide | 360 | 77.2 | 0 | 23.33 | 13.33 | 21.67 | 41.67 | 36.67 | 4 |
| 1C VP3 mature peptide | 423 | 77.17 | 0 | 20 | 15 | 21.67 | 43.33 | 35 | 5 |
| 1C VP3 mature peptide | 493 | 76.77 | 0 | 11.67 | 23.33 | 35 | 30 | 35 | 6 |
| 1C VP3 mature peptide | 554 | 76.13 | 0 | 15 | 20 | 28.33 | 36.67 | 35 | 3 |
| 1C VP3 mature peptide | 614 | 78.67 | 0 | 21.67 | 18.33 | 25 | 35 | 40 | 4 |
| 1D VP1 mature peptide | 60 | 78.57 | 0 | 31.67 | 11.67 | 33.33 | 23.33 | 43.33 | 4 |
| 1D VP1 mature peptide | 120 | 79.89 | 0 | 18.33 | 21.67 | 35 | 25 | 40 | 3 |
| 1D VP1 mature peptide | 247 | 76.59 | 0 | 20 | 15 | 31.67 | 33.33 | 35 | 3 |
| 1D VP1 mature peptide | 307 | 77.15 | 0 | 23.33 | 13.33 | 21.67 | 41.67 | 36.67 | 3 |
| 1D VP1 mature peptide | 367 | 79.08 | 0 | 21.67 | 18.33 | 36.67 | 23.33 | 40 | 4 |
| 1D VP1 mature peptide | 467 | 80.54 | 0 | 26.67 | 18.33 | 23.33 | 31.67 | 45 | 2 |
| 1D VP1 mature peptide | 527 | 78.63 | 0 | 23.33 | 16.67 | 25 | 35 | 40 | 5 |
| 1D VP1 mature peptide | 587 | 78.77 | 0 | 10 | 30 | 25 | 35 | 40 | 3 |
| 1D VP1 mature peptide | 652 | 76.68 | 0 | 15 | 20 | 26.67 | 38.33 | 35 | 4 |
| 1D VP1 mature peptide | 712 | 77.66 | 0 | 16.67 | 21.67 | 36.67 | 25 | 38.33 | 3 |
| 2A mature peptide | 74 | 75.99 | 0 | 25 | 10 | 35 | 30 | 35 | 4 |
| 2A mature peptide | 116 | 77.96 | 0 | 18.33 | 16.67 | 30 | 35 | 35 | 4 |
| 2A mature peptide | 156 | 77.7 | 0 | 20 | 16.67 | 30 | 33.33 | 36.67 | 4 |
| 2A mature peptide | 196 | 77.49 | 0 | 21.67 | 13.33 | 36.67 | 28.33 | 35 | 3 |
| 2A mature peptide | 287 | 77.59 | 0 | 33.33 | 6.67 | 35 | 25 | 40 | 3 |
| 2A mature peptide | 389 | 80.03 | 0 | 30 | 13.33 | 20 | 36.67 | 43.33 | 4 |
| 2A mature peptide | 432 | 76.63 | 0 | 21.67 | 13.33 | 30 | 35 | 35 | 6 |
| 2A mature peptide | 472 | 79.08 | 0 | 13.33 | 25 | 30 | 31.67 | 38.33 | 6 |
| 2A mature peptide | 512 | 78.94 | 0 | 18.33 | 21.67 | 40 | 20 | 40 | 5 |
| 2A mature peptide | 552 | 77.38 | 0 | 25 | 13.33 | 43.33 | 18.33 | 38.33 | 3 |
| 2B mature peptide | 60 | 79.54 | 0 | 26.67 | 15 | 33.33 | 25 | 41.67 | 3 |
| 2B mature peptide | 61 | 79.47 | 0 | 25 | 15 | 35 | 25 | 40 | 3 |
| 2B mature peptide | 62 | 78.97 | 0 | 25 | 15 | 35 | 25 | 40 | 3 |
| 2B mature peptide | 64 | 78.64 | 0 | 25 | 15 | 36.67 | 23.33 | 40 | 4 |
| 2B mature peptide | 65 | 79.2 | 0 | 25 | 15 | 36.67 | 23.33 | 40 | 4 |
| 2B mature peptide | 66 | 79.2 | 0 | 25 | 15 | 35 | 25 | 40 | 4 |
| 2B mature peptide | 67 | 78.5 | 0 | 23.33 | 15 | 35 | 26.67 | 38.33 | 4 |
| 2B mature peptide | 68 | 78.43 | 0 | 21.67 | 15 | 35 | 28.33 | 36.67 | 4 |
| 2B mature peptide | 69 | 78.43 | 0 | 21.67 | 15 | 33.33 | 30 | 36.67 | 4 |
| 2B mature peptide | 70 | 78.71 | 0 | 21.67 | 15 | 31.67 | 31.67 | 36.67 | 5 |

TABLE 1-continued

| Selected viral probes | | | | | | | | |
|---|---|---|---|---|---|---|---|---|
| 2C mature peptide | 60 | 76.89 | 0 | 23.33 | 13.33 | 36.67 | 26.67 | 36.67 | 4 |
| 2C mature peptide | 124 | 76.33 | 0 | 25 | 10 | 21.67 | 43.33 | 35 | 3 |
| 2C mature peptide | 232 | 77.11 | 0 | 11.67 | 23.33 | 33.33 | 31.67 | 35 | 5 |
| 2C mature peptide | 292 | 77.41 | 0 | 16.67 | 18.33 | 40 | 25 | 35 | 5 |
| 2C mature peptide | 352 | 77.62 | 0 | 20 | 18.33 | 25 | 36.67 | 38.33 | 5 |
| 2C mature peptide | 412 | 78.68 | 0 | 26.67 | 13.33 | 31.67 | 28.33 | 40 | 5 |
| 2C mature peptide | 472 | 77.56 | 0 | 25 | 11.67 | 28.33 | 35 | 36.67 | 3 |
| 2C mature peptide | 557 | 78.01 | 0 | 18.33 | 16.67 | 35 | 30 | 35 | 4 |
| 2C mature peptide | 617 | 80.04 | 0 | 35 | 6.67 | 31.67 | 26.67 | 41.67 | 5 |
| 2C mature peptide | 679 | 75.26 | 0 | 20 | 15 | 40 | 25 | 35 | 5 |
| 3A mature peptide | 131 | 81.75 | 0 | 26.67 | 18.33 | 18.33 | 36.67 | 45 | 4 |
| 3A mature peptide | 132 | 81.63 | 0 | 25 | 18.33 | 18.33 | 38.33 | 43.33 | 5 |
| 3A mature peptide | 133 | 81.68 | 0 | 25 | 20 | 18.33 | 36.67 | 45 | 5 |
| 3A mature peptide | 140 | 81.4 | 0 | 26.67 | 18.33 | 18.33 | 36.67 | 45 | 5 |
| 3A mature peptide | 141 | 81.28 | 0 | 25 | 18.33 | 18.33 | 38.33 | 43.33 | 5 |
| 3A mature peptide | 142 | 81.25 | 0 | 25 | 18.33 | 20 | 36.67 | 43.33 | 5 |
| 3A mature peptide | 143 | 80.74 | 0 | 25 | 18.33 | 21.67 | 35 | 43.33 | 5 |
| 3A mature peptide | 144 | 80.68 | 0 | 23.33 | 18.33 | 23.33 | 35 | 41.67 | 5 |
| 3A mature peptide | 145 | 79.89 | 0 | 23.33 | 18.33 | 21.67 | 36.67 | 41.67 | 5 |
| 3A mature peptide | 146 | 79.1 | 0 | 23.33 | 18.33 | 21.67 | 36.67 | 41.67 | 5 |
| 3B (VPg) mature peptide | 60 | 77.74 | 0 | 21.67 | 18.33 | 36.67 | 23.33 | 40 | 3 |
| 3B (VPg) mature peptide | 61 | 78.06 | 0 | 20 | 18.33 | 36.67 | 25 | 38.33 | 3 |
| 3B (VPg) mature peptide | 62 | 77.53 | 0 | 20 | 18.33 | 36.67 | 25 | 38.33 | 3 |
| 3B (VPg) mature peptide | 63 | 77.19 | 0 | 20 | 16.67 | 36.67 | 26.67 | 36.67 | 3 |
| 3B (VPg) mature peptide | 64 | 76.75 | 0 | 20 | 16.67 | 38.33 | 25 | 36.67 | 3 |
| 3B (VPg) mature peptide | 65 | 76.4 | 0 | 20 | 15 | 38.33 | 26.67 | 35 | 3 |
| 3B (VPg) mature peptide | 66 | 76.59 | 0 | 21.67 | 15 | 38.33 | 25 | 36.67 | 3 |
| 3B (VPg) mature peptide | 67 | 77.29 | 0 | 23.33 | 15 | 36.67 | 25 | 38.33 | 3 |
| 3B (VPg) mature peptide | 68 | 77.59 | 0 | 25 | 15 | 35 | 25 | 40 | 3 |
| 3B (VPg) mature peptide | 69 | 78.22 | 0 | 25 | 15 | 35 | 25 | 40 | 4 |
| 3C mature peptide | 90 | 77.51 | 0 | 20 | 15 | 30 | 35 | 35 | 4 |
| 3C mature peptide | 130 | 79.93 | 0 | 23.33 | 18.33 | 30 | 28.33 | 41.67 | 3 |
| 3C mature peptide | 214 | 81.56 | 0 | 33.33 | 11.67 | 31.67 | 23.33 | 45 | 4 |
| 3C mature peptide | 262 | 77.18 | 0 | 23.33 | 15 | 41.67 | 20 | 38.33 | 5 |
| 3C mature peptide | 302 | 79.04 | 0 | 23.33 | 18.33 | 33.33 | 25 | 41.67 | 4 |
| 3C mature peptide | 345 | 81.22 | 0 | 26.67 | 16.67 | 33.33 | 23.33 | 43.33 | 4 |
| 3C mature peptide | 388 | 75.69 | 0 | 18.33 | 16.67 | 31.67 | 33.33 | 35 | 4 |
| 3C mature peptide | 428 | 78.44 | 0 | 25 | 15 | 21.67 | 38.33 | 40 | 3 |
| 3C mature peptide | 468 | 76.48 | 0 | 20 | 15 | 23.33 | 41.67 | 35 | 3 |

TABLE 1-continued

| Selected viral probes | | | | | | | | |
|---|---|---|---|---|---|---|---|---|
| 3C mature peptide | 547 | 78.48 | 0 | 23.33 | 13.33 | 26.67 | 36.67 | 36.67 | 3 |
| 3D mature peptide | 65 | 75.79 | 0 | 23.33 | 11.67 | 26.67 | 38.33 | 35 | 4 |
| 3D mature peptide | 175 | 77.16 | 0 | 23.33 | 11.67 | 28.33 | 36.67 | 35 | 4 |
| 3D mature peptide | 235 | 77.77 | 0 | 23.33 | 11.67 | 36.67 | 28.33 | 35 | 6 |
| 3D mature peptide | 295 | 76.15 | 0 | 20 | 15 | 30 | 35 | 35 | 4 |
| 3D mature peptide | 355 | 80.71 | 0 | 20 | 23.33 | 33.33 | 23.33 | 43.33 | 3 |
| 3D mature peptide | 459 | 75.3 | 0 | 23.33 | 11.67 | 21.67 | 43.33 | 35 | 4 |
| 3D mature peptide | 568 | 76.5 | 0 | 15 | 20 | 25 | 40 | 35 | 3 |
| 3D mature peptide | 631 | 75.91 | 0 | 15 | 20 | 23.33 | 41.67 | 35 | 3 |
| 3D mature peptide | 691 | 80.51 | 0 | 20 | 23.33 | 28.33 | 28.33 | 43.33 | 4 |
| 3D mature peptide | 758 | 75.88 | 0 | 21.67 | 13.33 | 18.33 | 46.67 | 35 | 4 |
| ORF 1-polyprotein | 192 | 81.49 | 0 | 25 | 20 | 16.67 | 38.33 | 45 | 3 |
| ORF 1-polyprotein | 514 | 81.26 | 0 | 20 | 25 | 23.33 | 31.67 | 45 | 3 |
| ORF 1-polyprotein | 688 | 81.52 | 0 | 28.33 | 16.67 | 20 | 35 | 45 | 5 |
| ORF 1-polyprotein | 945 | 81.1 | 0 | 23.33 | 21.67 | 31.67 | 23.33 | 45 | 5 |
| ORF 1-polyprotein | 1243 | 81.02 | 0 | 25 | 20 | 25 | 30 | 45 | 4 |
| ORF 1-polyprotein | 1489 | 82.77 | 0 | 20 | 25 | 21.67 | 33.33 | 45 | 5 |
| ORF 1-polyprotein | 2292 | 81.07 | 0 | 20 | 25 | 30 | 25 | 45 | 3 |
| ORF 1-polyprotein | 2535 | 81.77 | 0 | 21.67 | 23.33 | 28.33 | 26.67 | 45 | 3 |
| ORF 1-polyprotein | 2953 | 79.59 | 0 | 18.33 | 26.67 | 20 | 35 | 45 | 4 |
| ORF 1-polyprotein | 3872 | 80.53 | 0 | 21.67 | 23.33 | 25 | 30 | 45 | 3 |
| Viral methyltransferase | 944 | 80.72 | 0 | 13.33 | 30 | 23.33 | 33.33 | 43.33 | 4 |
| Viral methyltransferase | 60 | 84.17 | 0 | 18.33 | 31.67 | 21.67 | 28.33 | 50 | 4 |
| Viral methyltransferase | 133 | 85.34 | 0 | 23.33 | 31.67 | 15 | 30 | 55 | 3 |
| Viral methyltransferase | 309 | 85.66 | 0 | 25 | 30 | 13.33 | 31.67 | 55 | 3 |
| Viral methyltransferase | 369 | 83.02 | 0 | 20 | 30 | 28.33 | 21.67 | 50 | 3 |
| Viral methyltransferase | 433 | 86.2 | 0 | 35 | 20 | 18.33 | 26.67 | 55 | 3 |
| Viral methyltransferase | 550 | 86.55 | 0 | 26.67 | 28.33 | 16.67 | 28.33 | 55 | 3 |
| Viral methyltransferase | 610 | 85.53 | 0 | 23.33 | 31.67 | 11.67 | 33.33 | 55 | 4 |
| Viral methyltransferase | 769 | 86.83 | 0 | 23.33 | 31.67 | 18.33 | 26.67 | 55 | 3 |
| Viral methyltransferase | 844 | 87.13 | 0 | 26.67 | 28.33 | 16.67 | 28.33 | 55 | 3 |
| Peptidase C41 | 60 | 85.09 | 0 | 28.33 | 25 | 18.33 | 28.33 | 53.33 | 4 |
| Peptidase C41 | 80 | 83.94 | 0 | 28.33 | 23.33 | 21.67 | 26.67 | 51.67 | 4 |
| Peptidase C41 | 100 | 84.32 | 0 | 26.67 | 25 | 20 | 28.33 | 51.67 | 4 |
| Peptidase C41 | 120 | 85.83 | 0 | 25 | 30 | 21.67 | 23.33 | 55 | 4 |
| Peptidase C41 | 240 | 85.25 | 0 | 20 | 35 | 18.33 | 26.67 | 55 | 3 |
| Peptidase C41 | 264 | 85.6 | 0 | 23.33 | 31.67 | 18.33 | 26.67 | 55 | 4 |
| Peptidase C41 | 284 | 84.24 | 0 | 30 | 25 | 20 | 25 | 55 | 4 |
| Peptidase C41 | 365 | 86.97 | 0 | 30 | 25 | 20 | 25 | 55 | 4 |

TABLE 1-continued

| Selected viral probes | | | | | | | | |
|---|---|---|---|---|---|---|---|---|
| Peptidase C41 | 385 | 84.04 | 0 | 30 | 20 | 16.67 | 33.33 | 50 | 4 |
| Peptidase C41 | 405 | 83.26 | 0 | 33.33 | 16.67 | 18.33 | 31.67 | 50 | 4 |
| Viral helicase 1 | 60 | 86.01 | 0 | 25 | 30 | 21.67 | 23.33 | 55 | 2 |
| Viral helicase 1 | 61 | 86.57 | 0 | 25 | 30 | 21.67 | 23.33 | 55 | 2 |
| Viral helicase 1 | 64 | 86.38 | 0 | 23.33 | 31.67 | 20 | 25 | 55 | 3 |
| Viral helicase 1 | 65 | 86.38 | 0 | 25 | 30 | 20 | 25 | 55 | 3 |
| Viral helicase 1 | 67 | 86.95 | 0 | 23.33 | 31.67 | 18.33 | 26.67 | 55 | 3 |
| Viral helicase 1 | 102 | 86.17 | 0 | 25 | 30 | 16.67 | 28.33 | 55 | 3 |
| Viral helicase 1 | 103 | 86.05 | 0 | 23.33 | 30 | 18.33 | 28.33 | 53.33 | 3 |
| Viral helicase 1 | 104 | 86.14 | 0 | 23.33 | 31.67 | 18.33 | 26.67 | 55 | 3 |
| Viral helicase 1 | 106 | 86.75 | 0 | 21.67 | 33.33 | 20 | 25 | 55 | 3 |
| Viral helicase 1 | 107 | 86.47 | 0 | 21.67 | 33.33 | 20 | 25 | 55 | 3 |
| RNA dependent RNA pol. | 113 | 81.26 | 0 | 20 | 25 | 23.33 | 31.67 | 45 | 3 |
| RNA dependent RNA pol. | 114 | 80.83 | 0 | 20 | 25 | 23.33 | 31.67 | 45 | 3 |
| RNA dependent RNA pol. | 115 | 80.85 | 0 | 20 | 25 | 23.33 | 31.67 | 45 | 3 |
| RNA dependent RNA pol. | 287 | 81.52 | 0 | 28.33 | 16.67 | 20 | 35 | 45 | 5 |
| RNA dependent RNA pol. | 288 | 81.52 | 0 | 28.33 | 16.67 | 21.67 | 33.33 | 45 | 5 |
| RNA dependent RNA pol. | 290 | 80.94 | 0 | 28.33 | 16.67 | 20 | 35 | 45 | 5 |
| RNA dependent RNA pol. | 291 | 80.23 | 0 | 26.67 | 16.67 | 20 | 36.67 | 43.33 | 5 |
| RNA dependent RNA pol. | 292 | 80.1 | 0 | 25 | 16.67 | 20 | 38.33 | 41.67 | 5 |
| RNA dependent RNA pol. | 293 | 79.73 | 0 | 26.67 | 16.67 | 20 | 36.67 | 43.33 | 5 |
| RNA dependent RNA pol. | 294 | 80.02 | 0 | 25 | 16.67 | 21.67 | 36.67 | 41.67 | 5 |
| ORF 3-hypothetical protein | 211 | 85.04 | 0 | 18.33 | 35 | 20 | 26.67 | 53.33 | 4 |
| ORF 3-hypothetical protein | 212 | 84.93 | 0 | 18.33 | 33.33 | 20 | 28.33 | 51.67 | 4 |
| ORF 3-hypothetical protein | 213 | 85.04 | 0 | 20 | 33.33 | 18.33 | 28.33 | 53.33 | 4 |
| ORF 3-hypothetical protein | 214 | 85.22 | 0 | 21.67 | 33.33 | 16.67 | 28.33 | 55 | 4 |
| ORF 3-hypothetical protein | 215 | 85.04 | 0 | 21.67 | 31.67 | 16.67 | 30 | 53.33 | 4 |
| ORF 3-hypothetical protein | 216 | 85.04 | 0 | 23.33 | 30 | 16.67 | 30 | 53.33 | 4 |
| ORF 3-hypothetical protein | 217 | 85.75 | 0 | 25 | 30 | 15 | 30 | 55 | 4 |
| ORF 3-hypothetical protein | 204 | 85.2 | 0 | 15 | 40 | 20 | 25 | 55 | 4 |
| ORF 3-hypothetical protein | 205 | 85.22 | 0 | 15 | 40 | 20 | 25 | 55 | 4 |
| ORF 3-hypothetical protein | 206 | 85.92 | 0 | 16.67 | 38.33 | 20 | 25 | 55 | 4 |
| ORF 2-capsid protein | 323 | 80.69 | 0 | 20 | 25 | 30 | 25 | 45 | 3 |
| ORF 2-capsid protein | 324 | 80.56 | 0 | 18.33 | 25 | 31.67 | 25 | 43.33 | 3 |

TABLE 1-continued

| Selected viral probes | | | | | | | | | |
|---|---|---|---|---|---|---|---|---|---|
| ORF 2-capsid protein | 325 | 80.31 | 0 | 18.33 | 25 | 31.67 | 25 | 43.33 | 3 |
| ORF 2-capsid protein | 326 | 80.37 | 0 | 18.33 | 26.67 | 30 | 25 | 45 | 3 |
| ORF 2-capsid protein | 327 | 80.47 | 0 | 18.33 | 26.67 | 30 | 25 | 45 | 3 |
| ORF 2-capsid protein | 328 | 80.12 | 0 | 16.67 | 26.67 | 30 | 26.67 | 43.33 | 3 |
| ORF 2-capsid protein | 329 | 79.78 | 0 | 16.67 | 28.33 | 28.33 | 26.67 | 45 | 3 |
| ORF 2-capsid protein | 330 | 80.15 | 0 | 15 | 28.33 | 30 | 26.67 | 43.33 | 3 |
| ORF 2-capsid protein | 331 | 79.86 | 0 | 15 | 28.33 | 30 | 26.67 | 43.33 | 3 |
| ORF 2-capsid protein | 332 | 79.5 | 0 | 16.67 | 28.33 | 30 | 25 | 45 | 3 |
| RNA dependent RNA pol. | 69 | 81.65 | 0 | 20 | 25 | 31.67 | 23.33 | 45 | 3 |
| RNA dependent RNA pol. | 130 | 80.78 | 0 | 11.67 | 30 | 31.67 | 26.67 | 41.67 | 4 |
| RNA dependent RNA pol. | 214 | 80.92 | 0 | 23.33 | 21.67 | 20 | 35 | 45 | 3 |
| RNA dependent RNA pol. | 442 | 80.83 | 0 | 20 | 25 | 28.33 | 26.67 | 45 | 3 |
| RNA dependent RNA pol. | 502 | 76.41 | 0 | 11.67 | 23.33 | 35 | 30 | 35 | 3 |
| RNA dependent RNA pol. | 562 | 77.91 | 0 | 16.67 | 21.67 | 28.33 | 33.33 | 38.33 | 3 |
| RNA dependent RNA pol. | 622 | 80.63 | 0 | 13.33 | 30 | 20 | 36.67 | 43.33 | 3 |
| RNA dependent RNA pol. | 682 | 79.55 | 0 | 15 | 26.67 | 23.33 | 35 | 41.67 | 3 |
| RNA dependent RNA pol. | 765 | 81.34 | 0 | 20 | 25 | 23.33 | 31.67 | 45 | 5 |
| RNA dependent RNA pol. | 853 | 80.88 | 0 | 15 | 30 | 26.67 | 28.33 | 45 | 4 |
| Putative protease cofactor | 80 | 81.54 | 0 | 26.67 | 18.33 | 18.33 | 36.67 | 45 | 5 |
| putative protease cofactor | 140 | 81.22 | 0 | 25 | 20 | 21.67 | 33.33 | 45 | 4 |
| putative protease cofactor | 224 | 80.72 | 0 | 20 | 25 | 15 | 40 | 45 | 3 |
| putative protease cofactor | 284 | 81.98 | 0 | 26.67 | 16.67 | 20 | 36.67 | 43.33 | 3 |
| putative protease cofactor | 346 | 83.3 | 0 | 30 | 15 | 30 | 25 | 45 | 6 |
| putative protease cofactor | 409 | 82.71 | 0 | 23.33 | 21.67 | 18.33 | 36.67 | 45 | 5 |
| putative protease cofactor | 476 | 81.05 | 0 | 20 | 25 | 21.67 | 33.33 | 45 | 3 |
| putative protease cofactor | 536 | 79.88 | 0 | 20 | 21.67 | 28.33 | 30 | 41.67 | 3 |
| putative protease cofactor | 625 | 81.68 | 0 | 28.33 | 16.67 | 26.67 | 28.33 | 45 | 4 |
| putative protease cofactor | 703 | 81.33 | 0 | 20 | 25 | 23.33 | 31.67 | 45 | 2 |
| NTP-binding protein | 77 | 81.2 | 0 | 25 | 20 | 15 | 40 | 45 | 4 |
| NTP-binding protein | 148 | 82.13 | 0 | 25 | 20 | 15 | 40 | 45 | 4 |
| NTP-binding protein | 218 | 81.07 | 0 | 25 | 20 | 30 | 25 | 45 | 3 |
| NTP-binding protein | 278 | 80.23 | 0 | 28.33 | 15 | 25 | 31.67 | 43.33 | 5 |
| NTP-binding protein | 340 | 80.25 | 0 | 28.33 | 16.67 | 31.67 | 23.33 | 45 | 5 |
| NTP-binding protein | 400 | 79.53 | 0 | 28.33 | 11.67 | 30 | 30 | 40 | 4 |

TABLE 1-continued

| Selected viral probes | | | | | | | | |
|---|---|---|---|---|---|---|---|---|
| NTP-binding protein | 461 | 82.34 | 0 | 21.67 | 23.33 | 28.33 | 26.67 | 45 | 5 |
| NTP-binding protein | 521 | 79.93 | 0 | 20 | 21.67 | 33.33 | 25 | 41.67 | 3 |
| NTP-binding protein | 658 | 80.52 | 0 | 21.67 | 21.67 | 26.67 | 30 | 43.33 | 3 |
| NTP-binding protein | 718 | 81.13 | 0 | 23.33 | 21.67 | 28.33 | 26.67 | 45 | 4 |
| cysteine protease | 116 | 80.72 | 0 | 35 | 8.33 | 28.33 | 28.33 | 43.33 | 3 |
| cysteine protease | 162 | 80.95 | 0 | 28.33 | 15 | 26.67 | 30 | 43.33 | 2 |
| cysteine protease | 202 | 79.43 | 0 | 23.33 | 18.33 | 28.33 | 30 | 41.67 | 4 |
| cysteine protease | 293 | 79.61 | 0 | 20 | 20 | 30 | 30 | 40 | 3 |
| cysteine protease | 333 | 78.88 | 0 | 15 | 23.33 | 26.67 | 35 | 38.33 | 4 |
| cysteine protease | 377 | 81.6 | 0 | 21.67 | 23.33 | 25 | 30 | 45 | 4 |
| cysteine protease | 417 | 80.36 | 0 | 15 | 26.67 | 28.33 | 30 | 41.67 | 4 |
| cysteine protease | 457 | 77.1 | 0 | 25 | 10 | 33.33 | 31.67 | 35 | 3 |
| cysteine protease | 497 | 79.67 | 0 | 30 | 13.33 | 31.67 | 25 | 43.33 | 3 |
| cysteine protease | 537 | 78.55 | 0 | 25 | 15 | 28.33 | 31.67 | 40 | 6 |
| RNA-dependent RNA pol. | 60 | 79.2 | 0 | 21.67 | 16.67 | 26.67 | 35 | 38.33 | 5 |
| RNA-dependent RNA pol. | 120 | 79.34 | 0 | 23.33 | 16.67 | 25 | 35 | 40 | 3 |
| RNA-dependent RNA pol. | 180 | 77.5 | 0 | 16.67 | 18.33 | 28.33 | 36.67 | 35 | 4 |
| RNA-dependent RNA pol. | 240 | 79.94 | 0 | 25 | 16.67 | 36.67 | 21.67 | 41.67 | 5 |
| RNA-dependent RNA pol. | 300 | 80.36 | 0 | 25 | 18.33 | 26.67 | 30 | 43.33 | 5 |
| RNA-dependent RNA pol. | 360 | 78.03 | 0 | 20 | 16.67 | 36.67 | 26.67 | 36.67 | 4 |
| RNA-dependent RNA pol. | 420 | 80.67 | 0 | 25 | 16.67 | 35 | 23.33 | 41.67 | 4 |
| RNA-dependent RNA pol. | 510 | 81.16 | 0 | 25 | 20 | 26.67 | 28.33 | 45 | 3 |
| RNA-dependent RNA pol. | 573 | 81.41 | 0 | 25 | 20 | 33.33 | 21.67 | 45 | 4 |
| RNA-dependent RNA pol. | 736 | 81.66 | 0 | 31.67 | 11.67 | 31.67 | 25 | 43.33 | 4 |
| nucleocapsid protein | 99 | 77.34 | 0 | 20 | 15 | 36.67 | 28.33 | 35 | 3 |
| nucleocapsid protein | 159 | 79.32 | 0 | 31.67 | 10 | 30 | 28.33 | 41.67 | 3 |
| nucleocapsid protein | 226 | 82.08 | 0 | 18.33 | 26.67 | 31.67 | 23.33 | 45 | 5 |
| nucleocapsid protein | 311 | 80.47 | 0 | 23.33 | 21.67 | 26.67 | 28.33 | 45 | 2 |
| nucleocapsid protein | 371 | 76.59 | 0 | 20 | 16.67 | 35 | 28.33 | 36.67 | 4 |
| nucleocapsid protein | 431 | 79.43 | 0 | 31.67 | 13.33 | 33.33 | 21.67 | 45 | 3 |
| nucleocapsid protein | 499 | 80.41 | 0 | 31.67 | 13.33 | 28.33 | 26.67 | 45 | 3 |
| nucleocapsid protein | 559 | 81.55 | 0 | 15 | 30 | 23.33 | 31.67 | 45 | 3 |
| nucleocapsid protein | 635 | 81.41 | 0 | 26.67 | 18.33 | 28.33 | 26.67 | 45 | 4 |
| nucleocapsid protein | 723 | 81.28 | 0 | 23.33 | 21.67 | 25 | 30 | 45 | 3 |

TABLE 1-continued

| Selected viral probes | | | | | | | | | |
|---|---|---|---|---|---|---|---|---|---|
| phospoprotein | 90 | 74.7 | 0 | 23.33 | 11.67 | 31.67 | 33.33 | 35 | 3 |
| phospoprotein | 150 | 78.41 | 0 | 25 | 15 | 31.67 | 28.33 | 40 | 2 |
| phospoprotein | 210 | 79.22 | 0 | 25 | 15 | 31.67 | 28.33 | 40 | 4 |
| phospoprotein | 345 | 81.57 | 0 | 20 | 25 | 41.67 | 13.33 | 45 | 4 |
| phospoprotein | 431 | 81.09 | 0 | 23.33 | 21.67 | 31.67 | 23.33 | 45 | 3 |
| phospoprotein | 524 | 80.06 | 0 | 25 | 20 | 28.33 | 26.67 | 45 | 3 |
| phospoprotein | 592 | 78.34 | 0 | 30 | 10 | 40 | 20 | 40 | 5 |
| phospoprotein | 652 | 80.68 | 0 | 26.67 | 16.67 | 36.67 | 20 | 43.33 | 3 |
| phospoprotein | 712 | 77.31 | 0 | 20 | 16.67 | 23.33 | 40 | 36.67 | 3 |
| phospoprotein | 772 | 80.9 | 0 | 25 | 20 | 26.67 | 28.33 | 45 | 2 |
| gene"4b | 60 | 80.04 | 0 | 26.67 | 13.33 | 28.33 | 31.67 | 40 | 4 |
| gene"4b | 120 | 80.91 | 0 | 28.33 | 16.67 | 23.33 | 31.67 | 45 | 3 |
| gene"4b | 180 | 79.39 | 0 | 30 | 13.33 | 40 | 16.67 | 43.33 | 3 |
| gene"4b | 253 | 81.24 | 0 | 25 | 20 | 43.33 | 11.67 | 45 | 3 |
| gene"4b | 313 | 78.57 | 0 | 21.67 | 18.33 | 35 | 25 | 40 | 3 |
| gene"4b | 373 | 74.79 | 0 | 16.67 | 18.33 | 31.67 | 33.33 | 35 | 3 |
| gene"4b | 434 | 80.65 | 0 | 31.67 | 13.33 | 30 | 25 | 45 | 4 |
| gene"4b | 494 | 79.78 | 0 | 23.33 | 20 | 23.33 | 33.33 | 43.33 | 3 |
| gene"4b | 556 | 80.43 | 0 | 30 | 15 | 30 | 25 | 45 | 4 |
| gene"4b | 616 | 81.19 | 0 | 21.67 | 23.33 | 30 | 25 | 45 | 3 |
| matrix protein | 78 | 77.42 | 0 | 23.33 | 13.33 | 30 | 33.33 | 36.67 | 5 |
| matrix protein | 118 | 80.98 | 0 | 25 | 18.33 | 31.67 | 25 | 43.33 | 5 |
| matrix protein | 194 | 78.92 | 0 | 28.33 | 15 | 31.67 | 25 | 43.33 | 3 |
| matrix protein | 241 | 76.19 | 0 | 23.33 | 11.67 | 38.33 | 26.67 | 35 | 3 |
| matrix protein | 281 | 79.78 | 0 | 25 | 18.33 | 28.33 | 28.33 | 43.33 | 4 |
| matrix protein | 324 | 80.81 | 0 | 23.33 | 21.67 | 20 | 35 | 45 | 4 |
| matrix protein | 388 | 80.6 | 0 | 23.33 | 21.67 | 30 | 25 | 45 | 4 |
| matrix protein | 429 | 75.23 | 0 | 20 | 15 | 33.33 | 31.67 | 35 | 4 |
| matrix protein | 469 | 79.2 | 0 | 21.67 | 18.33 | 18.33 | 41.67 | 40 | 4 |
| matrix protein | 581 | 81.35 | 0 | 21.67 | 23.33 | 31.67 | 23.33 | 45 | 3 |
| gene G | 60 | 78.09 | 0 | 26.67 | 11.67 | 38.33 | 23.33 | 38.33 | 4 |
| gene G | 120 | 78.28 | 0 | 25 | 15 | 26.67 | 33.33 | 40 | 2 |
| gene G | 180 | 79.75 | 0 | 18.33 | 25 | 36.67 | 20 | 43.33 | 2 |
| gene G | 240 | 79.25 | 0 | 21.67 | 16.67 | 46.67 | 15 | 38.33 | 4 |
| gene G | 306 | 81.5 | 0 | 23.33 | 21.67 | 21.67 | 33.33 | 45 | 3 |
| gene G | 389 | 81.56 | 0 | 25 | 20 | 30 | 25 | 45 | 4 |
| gene G | 472 | 80.43 | 0 | 26.67 | 18.33 | 38.33 | 16.67 | 45 | 3 |
| gene G | 601 | 81.23 | 0 | 25 | 20 | 30 | 25 | 45 | 4 |
| gene G | 677 | 80.45 | 0 | 35 | 8.33 | 30 | 26.67 | 43.33 | 3 |
| gene G | 737 | 79.98 | 0 | 21.67 | 20 | 26.67 | 31.67 | 41.67 | 3 |
| RNA-dependent RNA pol. | 236 | 75.47 | 0 | 18.33 | 16.67 | 31.67 | 33.33 | 35 | 3 |
| RNA-dependent RNA pol. | 296 | 80.36 | 0 | 21.67 | 21.67 | 20 | 36.67 | 43.33 | 3 |
| RNA-dependent RNA pol. | 388 | 81.57 | 0 | 31.67 | 13.33 | 20 | 35 | 45 | 5 |
| RNA-dependent RNA pol. | 450 | 80.33 | 0 | 26.67 | 18.33 | 33.33 | 21.67 | 45 | 3 |
| RNA-dependent RNA pol. | 510 | 78.62 | 0 | 26.67 | 16.67 | 30 | 26.67 | 43.33 | 4 |
| RNA-dependent RNA pol. | 570 | 77.84 | 0 | 16.67 | 21.67 | 31.67 | 30 | 38.33 | 4 |
| RNA-dependent RNA pol. | 630 | 78.97 | 0 | 21.67 | 18.33 | 36.67 | 23.33 | 40 | 3 |
| RNA-dependent RNA pol. | 764 | 81.66 | 0 | 28.33 | 16.67 | 36.67 | 18.33 | 45 | 3 |
| RNA-dependent RNA pol. | 824 | 77.97 | 0 | 30 | 10 | 28.33 | 31.67 | 40 | 5 |
| RNA-dependent RNA pol. | 914 | 79.84 | 0 | 28.33 | 15 | 35 | 21.67 | 43.33 | 3 |
| 5' trailer RNA | 60 | 77.75 | 0 | 25 | 11.67 | 18.33 | 45 | 36.67 | 5 |
| 5' trailer RNA | 61 | 77.33 | 0 | 25 | 13.33 | 18.33 | 43.33 | 38.33 | 5 |
| 5' trailer RNA | 62 | 77 | 0 | 23.33 | 13.33 | 18.33 | 45 | 36.67 | 5 |
| 5' trailer RNA | 63 | 76.39 | 0 | 23.33 | 13.33 | 18.33 | 45 | 36.67 | 5 |
| 5' trailer RNA | 64 | 76.82 | 0 | 23.33 | 11.67 | 20 | 45 | 35 | 5 |
| 5' trailer RNA | 65 | 76.05 | 0 | 23.33 | 11.67 | 20 | 45 | 35 | 5 |
| 5' trailer RNA | 73 | 75.88 | 0 | 23.33 | 11.67 | 21.67 | 43.33 | 35 | 5 |
| 5' trailer RNA | 74 | 76.29 | 0 | 23.33 | 11.67 | 23.33 | 41.67 | 35 | 5 |

TABLE 1-continued

| Selected viral probes | | | | | | | | | |
|---|---|---|---|---|---|---|---|---|---|
| 5' trailer RNA | 75 | 76.29 | 0 | 23.33 | 11.67 | 25 | 40 | 35 | 5 |
| 5' trailer RNA | 76 | 76.39 | 0 | 25 | 11.67 | 25 | 38.33 | 36.67 | 5 |
| NS5 protein | 498 | 80.74 | 0 | 23.33 | 21.67 | 33.33 | 21.67 | 45 | 4 |
| NS5 protein | 559 | 81.87 | 0 | 25 | 20 | 35 | 20 | 45 | 5 |
| NS5 protein | 632 | 80.62 | 0 | 30 | 15 | 28.33 | 26.67 | 45 | 5 |
| NS5 protein | 872 | 82.48 | 0 | 20 | 25 | 28.33 | 26.67 | 45 | 4 |
| NS5 protein | 1080 | 81.39 | 0 | 28.33 | 16.67 | 40 | 15 | 45 | 4 |
| NS5 protein | 1140 | 81.31 | 0 | 26.67 | 16.67 | 23.33 | 33.33 | 43.33 | 3 |
| NS5 protein | 1284 | 81.05 | 0 | 31.67 | 13.33 | 28.33 | 26.67 | 45 | 2 |
| NS5 protein | 1350 | 81.53 | 0 | 23.33 | 21.67 | 31.67 | 23.33 | 45 | 5 |
| NS5 protein | 1411 | 78.37 | 0 | 23.33 | 15 | 43.33 | 18.33 | 38.33 | 5 |
| NS5 protein | 1506 | 81.82 | 0 | 25 | 20 | 36.67 | 18.33 | 45 | 3 |
| NS5 protein | 336 | 81.2 | 0 | 26.67 | 18.33 | 26.67 | 28.33 | 45 | 3 |
| NS5 protein | 399 | 81.27 | 0 | 25 | 20 | 33.33 | 21.67 | 45 | 4 |
| NS5 protein | 508 | 80.62 | 0 | 30 | 15 | 28.33 | 26.67 | 45 | 5 |
| NS5 protein | 748 | 82.48 | 0 | 20 | 25 | 28.33 | 26.67 | 45 | 4 |
| NS5 protein | 956 | 81.39 | 0 | 28.33 | 16.67 | 40 | 15 | 45 | 4 |
| NS5 protein | 1016 | 81.31 | 0 | 26.67 | 16.67 | 23.33 | 33.33 | 43.33 | 3 |
| NS5 protein | 1160 | 81.05 | 0 | 31.67 | 13.33 | 28.33 | 26.67 | 45 | 2 |
| NS5 protein | 1226 | 81.53 | 0 | 23.33 | 21.67 | 31.67 | 23.33 | 45 | 5 |
| NS5 protein | 1287 | 78.37 | 0 | 23.33 | 15 | 43.33 | 18.33 | 38.33 | 5 |
| NS5 protein | 1381 | 81.05 | 0 | 26.67 | 18.33 | 36.67 | 18.33 | 45 | 3 |
| NS5 protein | 101 | 81.2 | 0 | 26.67 | 18.33 | 26.67 | 28.33 | 45 | 3 |
| NS5 protein | 164 | 81.27 | 0 | 25 | 20 | 33.33 | 21.67 | 45 | 4 |
| NS5 protein | 273 | 80.62 | 0 | 30 | 15 | 28.33 | 26.67 | 45 | 5 |
| NS5 protein | 513 | 82.48 | 0 | 20 | 25 | 28.33 | 26.67 | 45 | 4 |
| NS5 protein | 721 | 81.39 | 0 | 28.33 | 16.67 | 40 | 15 | 45 | 4 |
| NS5 protein | 781 | 81.31 | 0 | 26.67 | 16.67 | 23.33 | 33.33 | 43.33 | 3 |
| NS5 protein | 925 | 81.05 | 0 | 31.67 | 13.33 | 28.33 | 26.67 | 45 | 2 |
| NS5 protein | 991 | 81.53 | 0 | 23.33 | 21.67 | 31.67 | 23.33 | 45 | 5 |
| NS5 protein | 1052 | 78.37 | 0 | 23.33 | 15 | 43.33 | 18.33 | 38.33 | 5 |
| NS5 protein | 1146 | 81.05 | 0 | 26.67 | 18.33 | 36.67 | 18.33 | 45 | 3 |
| NS5 protein | 375 | 80.74 | 0 | 23.33 | 21.67 | 33.33 | 21.67 | 45 | 4 |
| NS5 protein | 510 | 80.62 | 0 | 28.33 | 16.67 | 30 | 25 | 45 | 5 |
| NS5 protein | 749 | 82.48 | 0 | 20 | 25 | 28.33 | 26.67 | 45 | 4 |
| NS5 protein | 957 | 81.39 | 0 | 28.33 | 16.67 | 40 | 15 | 45 | 4 |
| NS5 protein | 1017 | 81.31 | 0 | 26.67 | 16.67 | 23.33 | 33.33 | 43.33 | 3 |
| NS5 protein | 1161 | 81.05 | 0 | 31.67 | 13.33 | 28.33 | 26.67 | 45 | 2 |
| NS5 protein | 1227 | 81.53 | 0 | 23.33 | 21.67 | 31.67 | 23.33 | 45 | 5 |
| NS5 protein | 1288 | 78.37 | 0 | 23.33 | 15 | 43.33 | 18.33 | 38.33 | 5 |
| NS5 protein | 1353 | 82.74 | 0 | 21.67 | 23.33 | 38.33 | 16.67 | 45 | 5 |
| NS5 protein | 1459 | 80.12 | 0 | 30 | 15 | 31.67 | 23.33 | 45 | 2 |
| 5UTR | 60 | 78.39 | 0 | 25 | 15 | 30 | 30 | 40 | 4 |
| 5UTR | 69 | 78.43 | 0 | 26.67 | 11.67 | 35 | 26.67 | 38.33 | 4 |
| capsid | 144 | 77.34 | 0 | 21.67 | 13.33 | 41.67 | 23.33 | 35 | 3 |
| capsid | 160 | 79.12 | 0 | 28.33 | 11.67 | 41.67 | 18.33 | 40 | 6 |
| propeptide | 174 | 80.99 | 0 | 23.33 | 21.67 | 28.33 | 26.67 | 45 | 3 |
| propeptide | 183 | 78.98 | 0 | 23.33 | 16.67 | 31.67 | 28.33 | 40 | 2 |
| membrane protein | 64 | 81.94 | 0 | 20 | 25 | 31.67 | 23.33 | 45 | 5 |
| membrane protein | 78 | 80.99 | 0 | 25 | 20 | 26.67 | 28.33 | 45 | 5 |
| envelope protein | 74 | 80.57 | 0 | 25 | 20 | 16.67 | 38.33 | 45 | 5 |
| envelope protein | 194 | 81.61 | 0 | 26.67 | 15 | 26.67 | 31.67 | 41.67 | 5 |
| envelope protein | 447 | 80.6 | 0 | 21.67 | 23.33 | 33.33 | 21.67 | 45 | 4 |
| envelope protein | 960 | 79.05 | 0 | 23.33 | 18.33 | 23.33 | 35 | 41.67 | 4 |
| envelope protein | 1198 | 82.15 | 0 | 26.67 | 18.33 | 28.33 | 26.67 | 45 | 5 |
| NS1 protein | 64 | 79.96 | 0 | 21.67 | 21.67 | 31.67 | 25 | 43.33 | 2 |
| NS1 protein | 439 | 80.43 | 0 | 26.67 | 16.67 | 38.33 | 18.33 | 43.33 | 4 |
| NS1 protein | 608 | 77.05 | 0 | 26.67 | 13.33 | 26.67 | 33.33 | 40 | 3 |
| NS1 protein | 866 | 81.68 | 0 | 28.33 | 16.67 | 31.67 | 23.33 | 45 | 5 |
| NS2A protein | 148 | 80.85 | 0 | 25 | 20 | 28.33 | 26.67 | 45 | 4 |
| NS2A protein | 152 | 80.03 | 0 | 25 | 18.33 | 28.33 | 28.33 | 43.33 | 4 |
| NS2A protein | 451 | 80.55 | 0 | 23.33 | 21.67 | 25 | 30 | 45 | 3 |
| NS2B protein | 287 | 81.46 | 0 | 28.33 | 16.67 | 40 | 15 | 45 | 5 |
| NS2B protein | 292 | 80.68 | 0 | 28.33 | 15 | 40 | 16.67 | 43.33 | 5 |
| NS2B protein | 297 | 81.32 | 0 | 30 | 15 | 36.67 | 18.33 | 45 | 5 |
| NS3 protein | 192 | 81.23 | 0 | 26.67 | 18.33 | 36.67 | 18.33 | 45 | 3 |
| NS3 protein | 395 | 80.79 | 0 | 15 | 30 | 28.33 | 26.67 | 45 | 3 |
| NS3 protein | 797 | 82.73 | 0 | 28.33 | 16.67 | 28.33 | 26.67 | 45 | 5 |
| NS3 protein | 1131 | 81.83 | 0 | 18.33 | 26.67 | 33.33 | 21.67 | 45 | 3 |
| NS4A protein | 246 | 81.88 | 0 | 33.33 | 11.67 | 23.33 | 31.67 | 45 | 5 |
| NS4A protein | 204 | 87.21 | 0 | 33.33 | 21.67 | 18.33 | 26.67 | 55 | 4 |

TABLE 1-continued

Selected viral probes

| | | | | | | | | | |
|---|---|---|---|---|---|---|---|---|---|
| NS4A protein | 383 | 86.35 | 0 | 28.33 | 26.67 | 28.33 | 16.67 | 55 | 3 |
| NS4B protein | 112 | 80.14 | 0 | 23.33 | 21.67 | 33.33 | 21.67 | 45 | 5 |
| NS4B protein | 819 | 80.74 | 0 | 23.33 | 21.67 | 28.33 | 26.67 | 45 | 3 |
| NS4B protein | 1082 | 80.52 | 0 | 26.67 | 16.67 | 33.33 | 23.33 | 43.33 | 3 |
| NS4B protein | 1506 | 80.98 | 0 | 31.67 | 13.33 | 38.33 | 16.67 | 45 | 3 |
| NS5 protein | 74 | 80.74 | 0 | 23.33 | 21.67 | 33.33 | 21.67 | 45 | 4 |
| NS5 protein | 716 | 81.31 | 0 | 26.67 | 16.67 | 23.33 | 33.33 | 43.33 | 3 |
| NS5 protein | 1172 | 79.51 | 0 | 30 | 15 | 35 | 20 | 45 | 3 |
| 3UTR | 61 | 84.45 | 0 | 40 | 15 | 25 | 20 | 55 | 4 |
| 3UTR | 70 | 84.24 | 0 | 33.33 | 21.67 | 23.33 | 21.67 | 55 | 4 |

WCCV - White clover cryptic virus;
BBWV - Broad bean wilt virus;
LNYV - Lettuce necrotic yellows virus

TABLE 2

Viral pathogens used in testing the Pathogen Chip

| Virus | Type/Strain | Source | References |
|---|---|---|---|
| CHIKV | R91064 | FDA/CBER Lot Release Panels* | |
| HAV | SD11 | Dr. Farci Lab | |
| HCV | Genotype 1b | Sera Care (Sera Care, Milford, MA) | |
| HCV | Genotype 2a | Sera Care (Sera Care, Milford, MA) | |
| HCV | Genotype 3 | Sera Care (Sera Care, Milford, MA) | |
| HEV | Genotype 3a | WHO Standard | |
| HIV-1 | Group M, Subtype B | FDA/CBER Lot Release Panels | 1, 2 |
| HIV-2 | Subtype B | FDA/CBER Lot Release Panels | 3 |
| DENGUE | Serotype 1, 2, 3 and 4 | Aedes albopictus C6/36 cell culture | 4 |
| HTLV-I | | ZeptoMetrix | |
| HTLV-II | | ZeptoMetrix | |
| WEST NILE | NY99 | Cell culture | 5 |
| ZIKA | PRVABC62 | FDA/CBER Lot Release Panels | |
| ZIKA | FSS13025 | FDA/CBER Lot Release Panels | |

*The FDA Center for Biologics Evaluation and Research (CBER), Division of Emerging and Transfusion Transmitted Diseases produces and makes available to blood donor screening test manufacturers panels which are sets of vialed human plasma containing virus particles that are carefully quantified for evaluating virus detection devices. Each set has several vials each one a different virus concentration and some with virus-free plasma. These panels are also used to test each new lot of a licensed blood donor screening device for release to the public, hence they are called Lot Release Panels. There are separate panels prepared for each type of virus.
1 Davis et al., J Virol Methods, 107: 37-44 (2003)
2 Lee et al., J Virol Methods, 137: 287-291 (2006)
3 Lee et al., J Virol Methods, 137: 287-291 (2005).
4 Dong et al., J Appl Microbiol, 120: 1119-1129 (2016).
5 Grinev et al., J Virol Methods, 154: 27-40 (2008).

Nucleic acids from positive plasma and from NATtrol were extracted using the Dynabeads™ SILANE Viral NA Kit (ThermoFisher Scientific, Waltham, MA) according to the manufacturer's protocol.

cDNA from random-primed, reverse-transcribed total RNA was performed with the Ovation® Pico WTA System (NuGEN, San Carlos, CA) using the manufacturer's recommended protocols and input amounts. For this study, the Agilent SureTag® Labeling Kit was used for generating Cy™3 dye labeled cDNA targets. Labeled cDNA was purified with SureTag® Kit spin columns and specific activities (degree of labeling) were calculated for use in hybridization reactions. A master mix containing 10× blocking agent and 2× GE hybridization buffer HI-RPM, was added to 3-5 µg of labeled cDNA, denatured, and hybridized to arrays under 8-chamber gasket slides at 65° C. with 20-rpm rotation for 24 hours in an Agilent hybridization oven. Arrays were processed using wash procedure A and scanned on an Agilent SureScan® G4900DA microarray scanner using 5-µm resolution.

Microarray-based platform data analysis: After scanning, microarray images were analyzed using Agilent Feature Extraction software (Agilent Technologies, Inc., Santa Clara, CA) with default protocols and settings. Average pixel intensity and subtraction of local background for each feature was calculated. Images were manually examined to note any arrays affected by high background, scratches, or other technical artifacts. Probe sets associated with low signal intensity or bad quality features were considered unreliable and excluded from the analysis. Feature intensities for Cy™3 dye channels were imported into the Partek™ Genomics Suite™ software (Partek Inc., St. Louis, MO, USA).

First, microarray analysis was performed by ranking the highest signal intensity probes by the mean of the set of probes defining each pathogen on the platform. Next, an experimental threshold was defined as a log ratio of signal intensity mean for the set of probes defining each pathogen and the mean of the Agilent control probes set. The threshold was applied to all the arrays tested to define the final parameters for test validation.

RT-qPCR Validation

Altona RT-qPCR: CHIKV, DENV 1-4 and ZIKV positive specimens were quantified using the Altona RealStar RT-qPCR kit (Altona Diagnostic GmbH, Hamburg, Germany) according to the manufacturer's instructions. The positive control and the internal control were provided by the manufacturer. Serial dilutions of CHIKV (ATCC VR-3246SD), DENV (ATCC VR-3231SD), and ZIKV (ATCC VR-1843DQ) quantitative genomic RNA (specification range: $1\times10^5$-$1\times10^6$ copies/4) obtained from ATCC (American Type Culture Collection Manassas, VA) were prepared to generate a standard curve for copy number quantification.

Primer Design (Genesig) RT-qPCR: HAV (target/5' NCR), HCV (5'UTR), HEV (ORF2), HIV-1 (target/POL), HIV-2 (target/POL), HTLVI (target/POL), HTLVII (target/POL), and WNV (5'UTR) positive specimens were quantified using the Primer Design Genesig kit (Primerdesign Ltd, United Kingdom) according to the manufacturer's protocol (OneStep RT-qPCR protocol). Each kit contained a positive control template for the PCR set up and for copy number determination (generated serial dilutions for the standard curve).

The RT-qPCR assays were performed on a ViiA7 Applied Biosystems real-time PCR system (Thermo Fisher Scientific Inc., Waltham, MA, USA). Each sample was tested in duplicate and the mean $C_q$ value was calculated.

Example 2

Microarray Design, Specificity, and Validation

Microarray design: The pathogen chip design strategy was to cover all high priority blood-borne RNA viruses (retroviruses and both positive- and negative-strand RNA viruses) using multiple probes to independent targets sites in the genome of each species. In total, 1,769 unique viral oligonucleotides derived from 16 distinct viral genomes (Table 1) were included that allowed discrimination of pathogens at the level of species, subtypes and genotypes. The microarray was supplemented with an additional number of predesigned GE array probes for 906 genes from the human genome, 84 ERCC probes and 120 probes specific for plant viruses representing negative controls (Table 3).

TABLE 3

Probe distribution on pathogen chip

| Probe group type | Number of targets | Number of probes | Purpose |
|---|---|---|---|
| All spot | 1010 | 14,716 | RNA pathogens coverage and internal controls |
| Pathogen Specific (not replicated) | 17 | 1,769 | Probes intensity analysis of pathogen specific genes |
| Internal Control (replicated 10 times) | 902 | 902 | Agilent requirement for probes normalization |
| ERCC probes (replicated 45 times) | 84 | 84 | Determination of intra-probe variance |
| Negative Control (not replicated) | 3 | 120 | Determination of probes cross reactivity |

The design included multiple gene targets for each pathogen genome in order to select the best probes for the final platform design. The design strategy was to balance the number of probes for each pathogen with a final count of 90-110 probes each. Probes selected in the final design generated a more intense signal and produced higher percentage coverage of the specific genome across the different experiments (FIG. 1A).

Figure 2B:
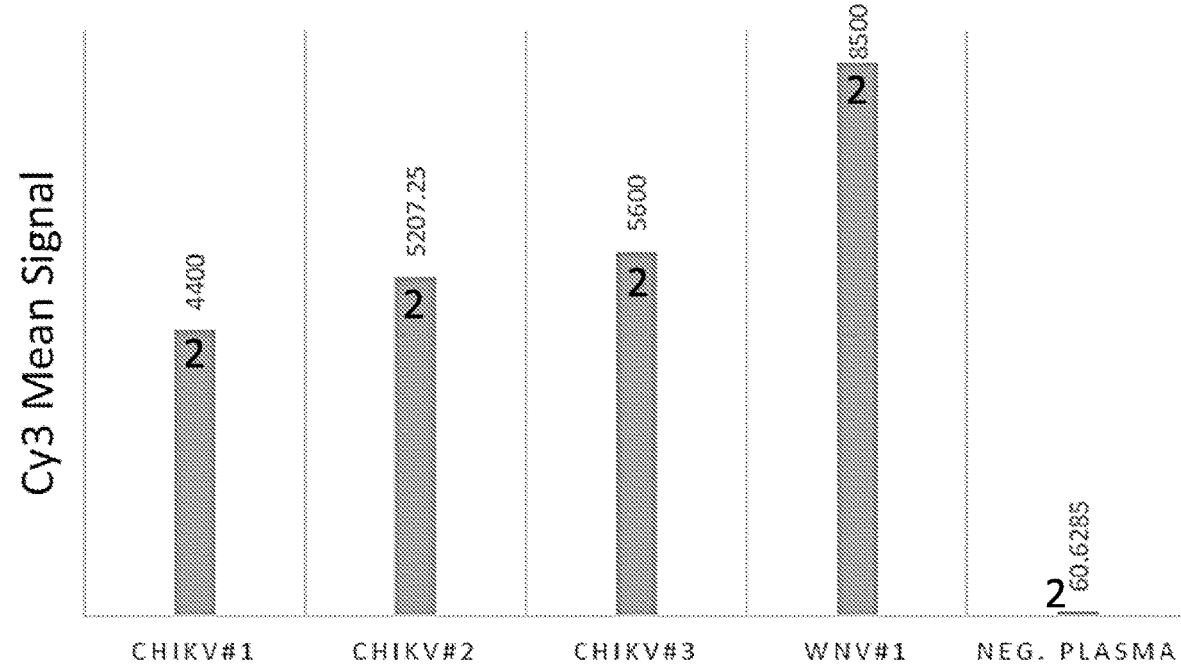
Figure 2C:
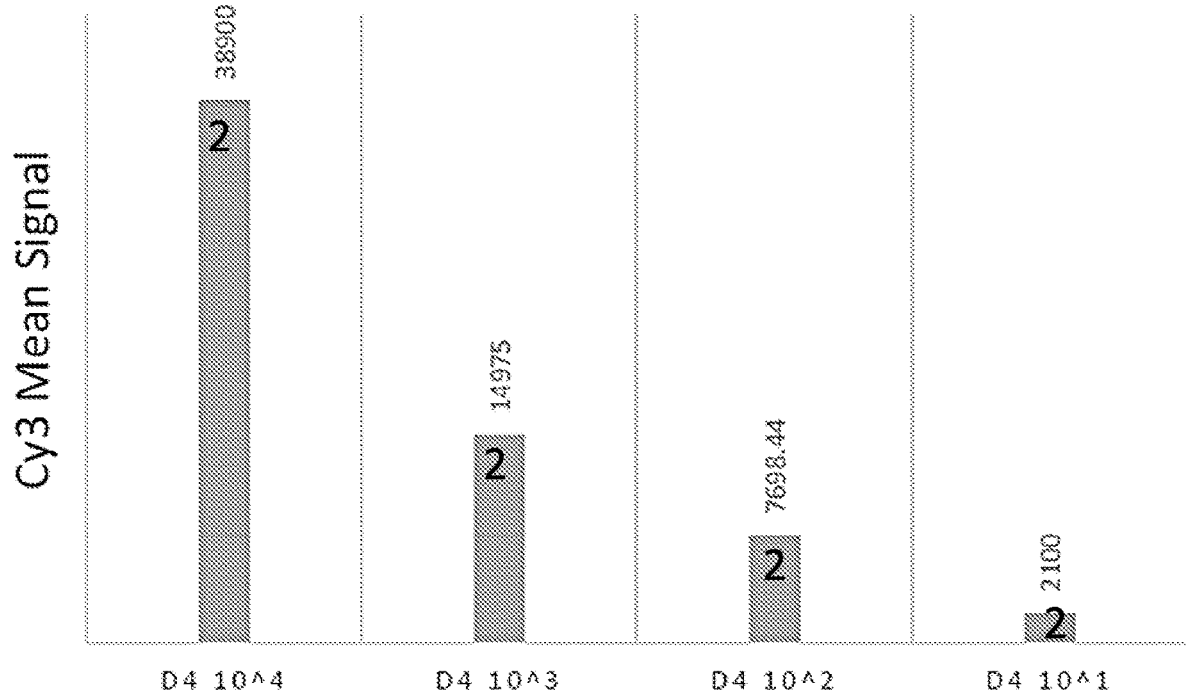

Microarray specificity: One of the challenges impacting the sensitivity of microarray based multi-pathogen nucleic acid detection in blood specimens is the relatively small concentration of target nucleic acids compared to a high background concentration of human DNA. A novel workflow was designed, combining two different applications (Agilent and Nugen), that had not been previously combined, to address this challenge. Typically, the Agilent amplification WT kit (Oligo dT) is used to amplify total RNA, with a minimum nucleic acid requirement of 25 nanograms, and produces a cRNA final product that is labelled with Cy3 fluorophore. The workflow was modified using a method that generates amplified cDNA from as little as 500 picograms of target viral RNA. One single-primer isothermal amplification using Nugen Ribo-SPIA technology was combined with the Agilent Genomic DNA Enzymatic Labeling Kit for generating Cy3 labeled cDNA. This kit was not previously developed for single color RNA probes and produces 300% the amplified product compared to the standard methodology (FIG. 1B, FIG. 2A). Nearly all samples were detected on the platform and all probes generated a strong signal specific for each positive plasma specimen analyzed. No specific signal was produced by negative control plasma (FIG. 2B). Random non-specific intensity signal was produced in only a few arrays. This indicated that the generation of cDNA instead of amplified RNA followed by Cy3 labelling and hybridization based on a DNA application was successful (FIG. 2C).

Analysis strategies: Quality of signals generated by probes for each species was assessed according to two experimental criteria: 1) defining a threshold able to distinguish a true signal from its background; and 2) defining true positives only when 50% of probes generated a signal above the set threshold. These two levels of data analysis were needed to detect positive probes in the presence of multi-pathogen testing at the same time and at different concentrations.

The threshold was defined as the log ratio between the signal intensity mean for each pathogen specific probe set and the mean of the Agilent control group probe set. After comparing the results of the same set of probes across different arrays and selecting the probes showing an inter-array reproducibility, an experimental threshold value was defined as follows: Log Ratio <1 negative; Log Ratio ≥1.0 to ≤1.5 borderline; Log Ratio ≥1.5 positive.

Data analysis at the individual probe level was also performed to assess if the tested samples were false positives. Only when at least 50% of specific probes had Log Ratio >1.5 was the test considered valid (FIG. 1C).

For nearly all borderline results, only 20-25% of the specific probes showed mean intensity in the correct range, so the test was defined negative. For positive results (Log Ratio >1.5) more than 50% of the specific probes set were in the correct range. One example was an HCV 1a positive plasma samples test that was detected by 110 out of 110 probes at a concentration of $10^5$ copies/mL, 90 out of 110 probes at a concentration of $10^4$ copies/mL, and 70 out of 110 probes at a concentration of $10^3$ copies/mL. On average, at $10^2$ copies/mL more than 50% of the probes were generating a fluorescence signal above the set threshold.

Data from more than 168 tested samples (one or multiple targets per array) showed consistent results. The mean of the probes specific for any positive plasma sample was always at least 10-fold higher than the mean of internal control probes (background), showing a wide probe population range of intensity. As shown in Table 4 and Table 5, the Log Ratio was above 1.5 for all the pathogens tested at a concentration of $10^2$ copies/mL and there were no cross reactions with other probes across the platform.

Microarray sensitivity: HAV, CHIKV, DENV1-4, HCV Genotypes 1a, 2b, and 3, HIV-1,2 and WNV strain NY99 had $10^2$ copies/mL limits of detection. The lowest detectable level for HEV was $10^4$ copies/mL. The analytical sensitivity for each assay was determined using a concentration range based on the clinical requirement for pathogen detection. There were no false negatives or false positives when testing the positive plasma. In the presence of very low pathogen concentrations, the log ratio was at the borderline level so the results were qualified according to double level analysis (at least 50% of the probes generated a fluorescence signal above the set threshold). In the presence of negative plasma samples, the log ratio value was always negative (Table 4).

A mix of different positive plasma samples at different concentrations was simultaneously tested in a single experiment. Four different combinations were generated. The multi-pathogens-mixes were composed of 8 (CHIKV, DEN3, DEN1, HAV, HCV1a, HEV, WNV and ZIKV), 4 (CHIKV, DEN1, ZKV, WNV), 4 (DENV3, HAV HCV1a HEV) and 3 (CHIKV, DEN1, ZIKV) different pathogens, respectively at a concentration range from $10^5$ to $10^3$ copies/mL. (Table 6).

TABLE 4

Test results based on Log ratio

|        | CK    | DEN1  | DEN2  | DEN3  | DEN4  | HAV   | HCV1a | HCV2a |
|--------|-------|-------|-------|-------|-------|-------|-------|-------|
| CK     | 2.42  | −1.15 | −1.22 | −0.04 | −0.28 | −0.50 | −0.24 | −0.35 |
| DEN1   | −0.12 | 1.60  | −0.33 | 0.09  | 0.14  | −0.08 | −0.20 | −0.31 |
| DEN2   | −0.24 | −0.82 | 1.84  | −0.30 | −0.25 | −0.24 | −0.17 | −0.28 |
| DEN3   | 0.03  | −0.19 | −0.02 | 1.62  | −0.24 | −0.28 | −0.24 | −0.34 |
| DEN4   | 0.07  | −0.31 | −0.64 | 0.18  | 1.80  | −0.64 | −0.17 | −0.28 |
| HAV    | −0.06 | −0.97 | −1.24 | −0.25 | −0.34 | 2.97  | −0.21 | −0.31 |
| HCV1   | 0.46  | −0.53 | −0.55 | 0.63  | 0.56  | 0.26  | 2.91  | 2.80  |
| HCV2   | 0.47  | −0.60 | −0.72 | 0.66  | 0.31  | 0.09  | 2.16  | 2.85  |
| HCV3   | 0.39  | −0.73 | −0.77 | 0.06  | 0.06  | −0.07 | 2.63  | 2.53  |
| HEV    | 0.41  | −0.62 | −0.63 | 0.23  | 0.35  | 1.06  | −0.14 | −0.24 |
| HIV1   | 0.96  | 0.55  | 0.08  | 0.77  | 0.56  | 0.01  | 0.05  | −0.06 |
| HIV2   | −0.13 | −0.90 | −0.94 | 0.02  | −0.29 | −0.07 | −0.09 | −0.20 |
| HTLVI  | −0.57 | −1.29 | −1.43 | −0.35 | −0.55 | −0.51 | −0.06 | −0.17 |
| HTLVII | −0.21 | −1.11 | −1.19 | −0.45 | −0.40 | −0.21 | 0.19  | 0.08  |
| WNV    | 0.10  | −0.50 | −0.70 | 0.21  | −0.34 | −0.33 | −0.19 | −0.29 |
| ZKV    | −0.29 | −0.64 | −0.92 | −0.49 | −0.41 | −0.45 | 0.12  | 0.26  |

|        | HCV3  | HEV   | HIV-1 | HIV-2 | HTLVI | HTLVII | WNV   | ZKV   | NC    |
|--------|-------|-------|-------|-------|-------|--------|-------|-------|-------|
| CK     | −0.56 | −0.02 | −0.99 | −0.68 | −0.42 | −0.96  | −0.97 | −0.20 | −0.96 |
| DEN1   | −0.52 | 0.46  | −0.76 | −0.55 | −0.28 | −0.76  | −0.53 | 0.00  | −0.86 |
| DEN2   | −0.49 | −0.11 | −1.13 | −0.89 | −0.52 | −0.84  | −1.00 | −0.28 | −1.01 |
| DEN3   | −0.55 | 0.01  | −0.95 | −0.81 | −0.56 | −0.91  | −0.22 | 0.05  | −0.96 |
| DEN4   | −0.49 | −0.20 | −1.02 | −0.80 | −0.66 | −1.05  | −0.30 | −0.36 | −1.07 |
| HAV    | −0.52 | 0.35  | −0.78 | −0.47 | −0.35 | −0.71  | −1.22 | −0.04 | −0.69 |
| HCV1   | 2.59  | 0.79  | −0.30 | 0.94  | 0.44  | −0.05  | −0.43 | 0.60  | −0.37 |
| HCV2   | 1.84  | 0.76  | −0.53 | 0.65  | −0.10 | −0.37  | −0.05 | 0.50  | −0.32 |
| HCV3   | 2.32  | 0.34  | −0.28 | 0.92  | 0.02  | −0.51  | −0.68 | 0.28  | −0.46 |
| HEV    | −0.45 | 1.89  | −0.31 | −0.17 | 0.10  | −0.04  | −0.51 | 0.54  | −0.39 |
| HIV1   | −0.27 | 1.07  | 1.89  | 0.46  | −0.22 | 0.06   | 0.13  | 0.92  | 0.23  |
| HIV2   | −0.41 | 0.23  | 0.91  | 1.68  | −0.07 | −0.44  | −0.75 | 0.09  | −0.66 |
| HTLVI  | −0.38 | −0.21 | −1.08 | −0.87 | 2.67  | 0.88   | −1.47 | −0.15 | −0.99 |
| HTLVII | −0.13 | −0.09 | −0.92 | −0.59 | 0.38  | 3.30   | −1.13 | −0.10 | −0.86 |
| WNV    | −0.51 | 0.25  | −0.62 | −0.52 | −0.40 | −0.64  | 2.24  | 0.00  | −0.82 |
| ZKV    | 0.32  | 0.68  | −0.96 | −0.68 | −0.52 | −0.78  | 0.16  | 2.07  | −0.83 |

CK, Chikungunya virus;
DEN, dengue;
HAV, hepatitis A virus;
HCV, hepatitis C virus;
HEV, hepatitis E virus;
HIV, human immunodeficiency virus;
HTLV, Human T-cell lymphotropic virus;
WNV, West Nile Virus;
ZKV, Zika Virus;
NC, negative control.

TABLE 5

Multi-pathogen mix test results based on Log ratio

|         | MPM1  | MPM2  | MPM3  | MPM4  |
|---------|-------|-------|-------|-------|
| CHIKV   | 3.42  | 3.37  | 0.24  | 2.25  |
| DEN1    | 3.14  | 3.10  | 1.80  | 2.45  |
| DEN2    | 1.11  | 1.10  | −0.23 | 0.35  |
| DEN3    | 2.72  | 1.19  | 3.00  | 0.51  |
| DEN4    | 1.31  | 1.19  | 0.83  | 0.59  |
| HAV     | 1.33  | 0.12  | 2.18  | −1.13 |
| HCV-1a  | 2.53  | 0.61  | 2.72  | −0.59 |
| HCV-2a  | 2.16  | 0.66  | 2.44  | −0.65 |
| HCV-3   | 2.45  | 0.65  | 2.60  | −0.72 |
| HEV     | 1.64  | 0.67  | 1.21  | −0.71 |
| HIV-1   | 1.05  | 1.24  | 1.11  | −0.36 |
| HIV-2   | 0.13  | 0.24  | 0.17  | −0.81 |
| HTLV-I  | −0.17 | 0.06  | −0.07 | −1.37 |
| HTLV-II | −0.02 | 0.12  | −0.09 | −1.07 |
| WNV     | 1.63  | 1.65  | 0.11  | −0.03 |
| ZKV     | 3.09  | 3.04  | 0.30  | 1.98  |

MPM1 = CHIKV, HAV, HCV-1a, HEV, DEN3, DEN1, ZKV, WNV
MPM2 = CHIKV, DEN1, ZKV, WNV
MPM3 = HAV, HEV, DEN3, HCV-1a
MPM4 = CHIKV, ZKV, DEN1

TABLE 6

Pathogen Chip performance based plasma panel test results

| Pathogen    | Copies/mL | pos/total | qPCR Validation |
|-------------|-----------|-----------|-----------------|
| Chikungunya | $10^3$    | 1/1       | Y               |
| Chikungunya | $10^2$    | 4/4       | Y               |
| Dengue1     | $10^3$    | 3/3       | Y               |
| Dengue1     | $10^2$    | 2/2       | Y               |
| Dengue1     | $10^1$    | 0/1       | Y               |
| Dengue2     | $10^3$    | 3/3       | Y               |
| Dengue2     | $10^2$    | 3/3       | Y               |
| Dengue2     | $10^1$    | 0/1       | Y               |
| Dengue3     | $10^3$    | 3/3       | Y               |
| Dengue3     | $10^2$    | 3/3       | Y               |
| Dengue3     | $10^1$    | 0/1       | Y               |
| Dengue4     | $10^3$    | 3/3       | Y               |
| Dengue4     | $10^2$    | 3/3       | Y               |
| Dengue4     | $10^1$    | 0/1       | Y               |
| HAV         | $10^3$    | 2/2       | Y               |
| HAV         | $10^2$    | 2/2       | Y               |
| HCV-1a      | $10^3$    | 3/3       | Y               |
| HCV-1a      | $10^2$    | 3/3       | Y               |
| HCV-2a      | $10^2$    | 2/2       | Y               |
| HCV-3       | $10^2$    | 2/2       | Y               |
| HEV         | $10^4$    | 3/3       | Y               |

TABLE 6-continued

Pathogen Chip performance based plasma panel test results

| Pathogen | Copies/mL | pos/total | qPCR Validation |
|---|---|---|---|
| HEV | 10^3 | 0/2 | Y |
| HEV | 10^2 | 0/2 | NA |
| HIV-1 | 10^3 | 2/2 | y |
| HIV-1 | 10^2 | 2/2 | y |
| HIV-2 | 10^3 | 3/3 | y |
| HIV-2 | 10^2 | 3/3 | y |
| HTLV-I | 10^3 | 2/2 | y |
| HTLV-I | 10^2 | 2/2 | y |
| HTLV-II | 10^3 | 2/2 | y |
| HTLV-II | 10^2 | 2/2 | y |
| WNV (NY99) | 10^5 | 1/1 | y |
| WNV (NY99) | 10^4 | 1/1 | y |
| WNV (NY99) | 10^3 | 3/3 | y |
| WNV (NY99) | 10^2 | 4/4 | y |
| WNV (NY99) | 10^1 | 0/2 | NA |
| ZIKA PRVABC60 | 10^3 | 3/3 | Y |
| ZIKA PRVABC61 | 10^2 | 3/3 | Y |
| ZIKA PRVABC62 | 10^1 | 0/2 | Y |
| ZIKV FSS13025 | 10^3 | 3/3 | Y |
| ZIKV FSS13025 | 10^2 | 3/3 | Y |
| ZIKV FSS13025 | 10^1 | 0/2 | Y |
| MPM1 | 10^5-10^3 | 3/3 | y |
| MPM2 | 10^5-10^3 | 3/3 | y |
| MPM3 | 10^5-10^3 | 3/3 | y |
| MPM4 | 10^5-10^3 | 3/3 | y |

NA = not applicable

Among the 99 positive samples tested at a concentration ranking from $10^5$ to $10^2$ copies/mL, 92 out 92 samples were correctly detected. Only HEV testing resulted correct detection in 3 out of 7 positive samples (42%) at a final concentration of $10^4$ copies/mL. No specific signal was detected below this value. There were 21 positive samples that were not detected because the concentration was below the limit of detection of the platform (<$10^2$ copies/mL). In all four mix combinations all pathogens were detected without interference among the targets.

All of the samples tested (single or multiple pathogens at the same time) were performed at least 3 times each, with at least a week interval between the experiments, in order to test the reproducibility of the results. The consistency of positive results across the different arrays confirmed that the array design together with the double level analysis model performed well.

Validation of the limit of microarray data by RT-qPCR: Microarray-based pathogen chip results were confirmed by RT-qPCR of the RNA aliquots used for testing. All positive results were confirmed and the copy numbers for each pathogen were calculated to define the limit of the detection for each species on the array (Table 7).

TABLE 7

Validation of Pathogen Chip detection results

| Virus | Pathogen Chip Results | qPCR Ct Value | Virus Copy No. |
|---|---|---|---|
| CHIKV | POS | 26.9 | $3.1 \times 10^3$ |
| CHIKV | POS | 31.6 | $1.4 \times 10^2$ |
| CHIKV | POS | 31.5 | $1.6 \times 10^2$ |
| CHIKV | POS | 29.4 | $6.3 \times 10^2$ |
| CHIKV | POS | 29.7 | $5.8 \times 10^2$ |
| DENGUE-1 | POS | 31.1 | $2.3 \times 10^3$ |
| DENGUE-1 | POS | 34.4 | $3.0 \times 10^2$ |
| DENGUE-1 | NEG | 38.7 | 41 |
| DENGUE-2 | POS | 29.1 | $8.4 \times 10^3$ |
| DENGUE-2 | POS | 35.9 | $1.2 \times 10^2$ |
| DENGUE-2 | NEG | 38.9 | 18 |
| DENGUE-3 | POS | 29.3 | $7.1 \times 10^3$ |
| DENGUE-3 | POS | 32.7 | $8.4 \times 10^2$ |
| DENGUE-3 | NEG | 37.3 | 31 |
| DENGUE-4 | POS | 30.3 | $3.3 \times 10^3$ |
| DENGUE-4 | POS | 34.2 | $2.6 \times 10^2$ |
| DENGUE-4 | NEG | 37.0 | 79 |
| HAV | POS | 28.4 | $3.2 \times 10^3$ |
| HAV | POS | 39.1 | $2.8 \times 10^3$ |
| HAV | POS | 29.2 | $8.2 \times 10^2$ |
| HAV | POS | 32.2 | $1.2 \times 10^2$ |
| HCV-1a | POS | 26.2 | $4.1 \times 10^3$ |
| HCV-1a | POS | 31.4 | $1.6 \times 10^2$ |
| HCV-2a | POS | 27.4 | $3.8 \times 10^3$ |
| HCV-2a | POS | 32.1 | $1.8 \times 10^2$ |
| HCV-3 | POS | 33.1 | $1.4 \times 10^2$ |
| HEV | POS | 25.4 | $1.9 \times 10^4$ |
| HEV | NEG | 28.4 | $1.8 \times 10^3$ |
| HIV-1 | POS | 27.3 | $4.6 \times 10^3$ |
| HIV-1 | POS | 32.8 | $1.6 \times 10^2$ |
| HIV-2 | POS | 27.4 | $4.3 \times 10^3$ |
| HIV-2 | POS | 30.7 | $1.8 \times 10^2$ |
| HTLV-I | POS | 28.7 | $3.9 \times 10^3$ |
| HTLV-I | POS | 28.3 | $2.9 \times 10^2$ |
| HTLV-II | POS | 25.574 | $2.7 \times 10^3$ |
| HTLV-II | POS | 29.289 | $2.4 \times 10^2$ |
| WNV (NY99) | POS | 21.5 | $1.9 \times 10^5$ |
| WNV (NY99) | POS | 24.5 | $1.5 \times 10^4$ |
| WNV (NY99) | POS | 27.6 | $2.1 \times 10^3$ |
| WNV (NY99) | POS | 31.4 | $1.0 \times 10^2$ |
| ZIKA PRVABC60 | POS | 26.2 | $1.5 \times 10^3$ |
| ZIKA PRVABC60 | POS | 30.1 | $1.2 \times 10^2$ |
| ZIKA PRVABC60 | NEG | 31.8 | 41 |
| ZIKA FSS13025 | POS | 25.3 | $2.4 \times 10^3$ |
| ZIKA FSS13025 | POS | 29.1 | $1.3 \times 10^2$ |
| ZIKA FSS13025 | NEG | 33.0 | 17 |

Example 3

Microarray for Detection of DNA Viruses, Bacteria, and Protozoan Pathogens

A microarray for DNA viruses, bacteria, and protozoan pathogens was developed. The design included multiple gene targets for each pathogen genome in order to select the best probes for the final platform design. The design strategy was to choose the probes with the best "scores" (homology, thermodynamics, secondary structure and sequence complexity) balancing the cross-hybridization with the host genome and with other pathogens' genomes. The second design strategy was to balance the number of probes for each pathogen with a final count of 50-110 probes each. Probes selected in the final design generated a more intense signal and produced higher percentage coverage of the specific genome across the different experiments.

The final design was supplemented with predesigned DNA array probes (577 control probes, 225 replicates, and 11,620 backbone) specific for the reagents and the assay performance. These are used specifically for image orientation, to assess whether the samples are labeled, for the orientation of the platform during the scan process, and for measuring on element background. These probes form a hairpin and do not hybridize well with labeled sample of any species. In addition, 312 probes specific for three human housekeeping genes (ACTB, ARL1, CCDN1) and 109 probes specific for one Mosquito-specific virus and two plant viruses (Aedes albopictus densovirus 2, Maize streak virus, Tomato pseudo-curly top virus) were added to the design.

The microarray includes probes for cytomegalovirus (CMV; also known as HHV-5), Epstein Barr virus (EBV; also known as HHV-4), human herpesvirus 8 (HHV-8), human papilloma virus (HPV) type 6b HPV6, HPV11, HPV 16, HPV 17, hepatitis B virus (HBV) subtype adw, HBV subtype ayw, HBV subtype adr, HBV subtype ayr, and human parvovirus B19. Exemplary probes provided in Table 8 and include SEQ ID NOs: 1770-1852 (CMV), SEQ ID NOs: 1853-1917 (EBV B95-8), SEQ ID NOs: 1918-2023 (EBV AG876), SEQ ID NOs: 2024-2108 (HHV-8), SEQ ID NOs: 2109-2192 (HPV 6b), SEQ ID NOs: 2193-2271 (HPV 11), SEQ ID NOs: 2272-2342 (HPV 16), SEQ ID NOs: 2343-2419 (HPV 18), SEQ ID NOs: 2420-2470 (HBV subtype adw), SEQ ID NOs: 2471-2520 (HBV subtype ayw), SEQ ID NOs: 2521-2556 (HBV subtype adr), SEQ ID NOs: 2557-2602 (HBV subtype ayr), and SEQ ID NOs: 2603-2647 (human parvovirus B19).

The microarray also includes probes for *Treponema pallidum*, *Ehrlichia chaffeensis*, *Ehrlichia ewingii*, *Ehrlichia muris*, *Borrelia burgdorferi*, *Coxiella burnetii*, *Trypanosoma brucei*, *Trypanosoma cruzi*, *Leishmania major*, *Babesia microti*, *Plasmodium falciparum*, and *Plasmodium vivax*. Exemplary probes provided in Table 9 and include SEQ ID NOs: 2648-2751 (*Treponema pallidum*), SEQ ID NOs: 2752-2852 (*Ehrlichia chaffeensis*), SEQ ID NOs: 2853-2861 (*Ehrlichia ewingii*), SEQ ID NOs: 2862-2922 (*Ehrlichia muris*), SEQ ID NOs: 2923-3001 (*Borrelia burgdorferi*), SEQ ID NOs: 3002-3085 (*Coxiella burnetii*), SEQ ID NOs: 3086-3097 (*Trypanosoma brucei*), SEQ ID NO: 3098 (*Trypanosoma cruzi*), SEQ ID NOs: 3099-3113 (*Leishmania major*), SEQ ID NOs: 3114-3154 (*Babesia microti*), SEQ ID NOs: 3155-3185 (*Plasmodium falciparum*), and SEQ ID NOs: 3186-3207 (*Plasmodium vivax*).

Finally, the microarray includes housekeeping and negative control probes (Table 10). Exemplary probes include SEQ ID NOs: 3208-3301 (housekeeping gene ACTB), SEQ ID NOs: 3302-3385 (housekeeping gene ARL1), SEQ ID NOs: 3386-3519 (housekeeping gene CCDN1), SEQ ID NOs: 3520-3557 (*Aedes albopictus* densovirus 2), SEQ ID NO: 3558-3598 (Maize streak virus), and SEQ ID NOs: 3599-3628 (Tomato pseudo-curly top virus).

For sample analysis, viral DNA from plasma specimens was extracted with the Invitrogen Dynabeads™ SILANE viral NA kit. The kit is designed for highly predictable and consistent isolation of viral nucleic acids. Beads and buffers are optimized for sensitive isolation of viral DNA. DNA from bacteria and protozoans was extracted from whole blood with the QIAamp® DNA Blood Mini kit (Qiagen) according to the manufacturer's protocol.

SureTag® Labeling Kit (Agilent technology) was used to enzymatically label DNA from plasma and blood. A modified protocol was developed and optimized for efficient sample fragmentation, enzymatic labeling, and clean up. A master mix containing 10×aCGH blocking agent and 2×HI-RPM hybridization buffer, was added to 2.5-3 µg of labeled DNA, denatured, and hybridized to arrays under 8-chamber gasket slides at 67° C. with 20-rpm rotation for 24 hours in an Agilent hybridization oven. Arrays were processed using wash procedure A and scanned on an Agilent SureScan® G4900DA microarray scanner using 5-µm resolution.

CMV, *Trypanosoma*, Parvovirus B19, HBV, EBV (HHV-4), *Treponema*, *Babesia*, *Leishmania*, *Coxiella*, *Borrelia*, Papilloma Virus (HPV 6, 11, 16, 18), and *P. falciparum* had $10^4$-$10^3$ copies/mL limits of detection. There were no false negatives or false positives when testing the positive plasma. All the results were confirmed by RT-qPCR of the DNA aliquots used for testing. All positive results were confirmed and the copy numbers for each pathogen were calculated to define the limit of the detection for each species on the array.

TABLE 8

Exemplary DNA virus probes

| ProbeID | Start | End | SEQ ID NO: | Virus | Genomic Region | Product |
|---|---|---|---|---|---|---|
| CUST_P10000630 | 45812 | 45860 | 1770 | CMV (HHV-5) Cytomegalovirus | UL34 | protein |
| CUST_P10000631 | 45872 | 45916 | 1771 | CMV (HHV-5) Cytomegalovirus | UL34 | protein |
| CUST_P10000638 | 46336 | 46384 | 1772 | CMV (HHV-5) Cytomegalovirus | UL34 | protein |
| CUST_P10001082 | 78547 | 78591 | 1773 | CMV (HHV-5) Cytomegalovirus | UL54 | DNA rep |
| CUST_P10001099 | 79469 | 79514 | 1774 | CMV (HHV-5) Cytomegalovirus | UL54 | DNA rep |
| CUST_P10001109 | 80183 | 80227 | 1775 | CMV (HHV-5) Cytomegalovirus | UL54 | DNA rep |
| CUST_P10001111 | 80253 | 80301 | 1776 | CMV (HHV-5) Cytomegalovirus | UL54 | DNA rep |
| CUST_P10001120 | 80933 | 80979 | 1777 | CMV (HHV-5) Cytomegalovirus | UL54 | DNA rep |
| CUST_P10001123 | 81072 | 81116 | 1778 | CMV (HHV-5) Cytomegalovirus | UL54 | DNA rep |
| CUST_P10001126 | 81245 | 81289 | 1779 | CMV (HHV-5) Cytomegalovirus | UL54 | DNA rep |
| CUST_P10001131 | 81599 | 81643 | 1780 | CMV (HHV-5) Cytomegalovirus | UL54 | DNA rep |
| CUST_P10001132 | 81738 | 81782 | 1781 | CMV (HHV-5) Cytomegalovirus | UL54 | DNA rep |
| CUST_P10001140 | 82327 | 82375 | 1782 | CMV (HHV-5) Cytomegalovirus | UL55 | envelop |
| CUST_P10001146 | 82856 | 82901 | 1783 | CMV (HHV-5) Cytomegalovirus | UL55 | envelop |
| CUST_P10001152 | 83347 | 83399 | 1784 | CMV (HHV-5) Cytomegalovirus | UL55 | envelop |
| CUST_P10001154 | 83475 | 83525 | 1785 | CMV (HHV-5) Cytomegalovirus | UL55 | envelop |
| CUST_P10001155 | 83645 | 83701 | 1786 | CMV (HHV-5) Cytomegalovirus | UL55 | envelop |
| CUST_P10001156 | 83677 | 83724 | 1787 | CMV (HHV-5) Cytomegalovirus | UL55 | envelop |
| CUST_P10001158 | 83744 | 83797 | 1788 | CMV (HHV-5) Cytomegalovirus | UL55 | envelop |
| CUST_P10001160 | 83961 | 84012 | 1789 | CMV (HHV-5) Cytomegalovirus | UL55 | envelop |
| CUST_P10001161 | 83993 | 84052 | 1790 | CMV (HHV-5) Cytomegalovirus | UL55 | envelop |
| CUST_P10001162 | 84021 | 84073 | 1791 | CMV (HHV-5) Cytomegalovirus | UL55 | envelop |
| CUST_P10001164 | 84223 | 84275 | 1792 | CMV (HHV-5) Cytomegalovirus | UL55 | envelop |
| CUST_P10001165 | 84398 | 84442 | 1793 | CMV (HHV-5) Cytomegalovirus | UL55 | envelop |
| CUST_P10001169 | 84665 | 84716 | 1794 | CMV (HHV-5) Cytomegalovirus | UL55 | envelop |
| CUST_P10001175 | 85014 | 85071 | 1795 | CMV (HHV-5) Cytomegalovirus | UL56 | encapsi |
| CUST_P10001177 | 85085 | 85132 | 1796 | CMV (HHV-5) Cytomegalovirus | UL56 | encapsi |
| CUST_P10001179 | 85221 | 85272 | 1797 | CMV (HHV-5) Cytomegalovirus | UL56 | encapsi |
| CUST_P10001183 | 85645 | 85693 | 1798 | CMV (HHV-5) Cytomegalovirus | UL56 | encapsi |
| CUST_P10001189 | 86404 | 86461 | 1799 | CMV (HHV-5) Cytomegalovirus | UL56 | encapsi |

TABLE 8-continued

Exemplary DNA virus probes

| ProbeID | Start | End | SEQ ID NO: | Virus | Genomic Region | Product |
|---|---|---|---|---|---|---|
| CUST_P10001198 | 87249 | 87308 | 1800 | CMV (HHV-5) Cytomegalovirus | UL56 | encapsi |
| CUST_P10001603 | 117602 | 117650 | 1801 | CMV (HHV-5) Cytomegalovirus | UL80 | capsid |
| CUST_P10001618 | 118112 | 118156 | 1802 | CMV (HHV-5) Cytomegalovirus | UL80 | capsid |
| CUST_P10001622 | 118567 | 118615 | 1803 | CMV (HHV-5) Cytomegalovirus | UL80 | capsid |
| CUST_P10001664 | 121437 | 121483 | 1804 | CMV (HHV-5) Cytomegalovirus | UL83 | tegumen |
| CUST_P10001665 | 121470 | 121522 | 1805 | CMV (HHV-5) Cytomegalovirus | UL83 | tegumen |
| CUST_P10001666 | 121493 | 121543 | 1806 | CMV (HHV-5) Cytomegalovirus | UL83 | tegumen |
| CUST_P10001675 | 122579 | 122623 | 1807 | CMV (HHV-5) Cytomegalovirus | UL83 | tegumen |
| CUST_P10001945 | 141984 | 142028 | 1808 | CMV (HHV-5) Cytomegalovirus | UL97 | core |
| CUST_P10001948 | 142100 | 142144 | 1809 | CMV (HHV-5) Cytomegalovirus | UL97 | core |
| CUST_P10001960 | 142742 | 142789 | 1810 | CMV (HHV-5) Cytomegalovirus | UL97 | core |
| CUST_P10001965 | 143122 | 143180 | 1811 | CMV (HHV-5) Cytomegalovirus | UL97 | core |
| CUST_P10001966 | 143159 | 143203 | 1812 | CMV (HHV-5) Cytomegalovirus | UL97 | core |
| CUST_P10002353 | 170852 | 170896 | 1813 | CMV (HHV-5) Cytomegalovirus | UL122 | Beta Ge |
| CUST_P10002359 | 171207 | 171256 | 1814 | CMV (HHV-5) Cytomegalovirus | UL122 | Beta Ge |
| CUST_P10002362 | 171393 | 171444 | 1815 | CMV (HHV-5) Cytomegalovirus | UL122 | Beta Ge |
| CUST_P10002371 | 171811 | 171858 | 1816 | CMV (HHV-5) Cytomegalovirus | UL122 | Beta Ge |
| CUST_P10002377 | 172241 | 172300 | 1817 | CMV (HHV-5) Cytomegalovirus | UL122 | Beta Ge |
| CUST_P10002378 | 172286 | 172345 | 1818 | CMV (HHV-5) Cytomegalovirus | UL122 | Beta Ge |
| CUST_P10002379 | 172307 | 172366 | 1819 | CMV (HHV-5) Cytomegalovirus | UL122 | Beta Ge |
| CUST_P10002381 | 172506 | 172559 | 1820 | CMV (HHV-5) Cytomegalovirus | UL122 | Beta Ge |
| CUST_P10002382 | 172633 | 172678 | 1821 | CMV (HHV-5) Cytomegalovirus | UL122 | Beta Ge |
| CUST_P10002384 | 172987 | 173046 | 1822 | CMV (HHV-5) Cytomegalovirus | UL122 | Beta Ge |
| CUST_P10002385 | 173023 | 173082 | 1823 | CMV (HHV-5) Cytomegalovirus | UL122 | Beta Ge |
| CUST_P10002386 | 173044 | 173097 | 1824 | CMV (HHV-5) Cytomegalovirus | UL122 | Beta Ge |
| CUST_P10002389 | 173134 | 173193 | 1825 | CMV (HHV-5) Cytomegalovirus | UL122 | Beta Ge |
| CUST_P10002390 | 173156 | 173215 | 1826 | CMV (HHV-5) Cytomegalovirus | UL122 | Beta Ge |
| CUST_P10002391 | 173191 | 173239 | 1827 | CMV (HHV-5) Cytomegalovirus | UL122 | Beta Ge |
| CUST_P10002392 | 173374 | 173433 | 1828 | CMV (HHV-5) Cytomegalovirus | UL122 | Beta Ge |
| CUST_P10002393 | 173395 | 173454 | 1829 | CMV (HHV-5) Cytomegalovirus | UL122 | Beta Ge |
| CUST_P10002394 | 173432 | 173489 | 1830 | CMV (HHV-5) Cytomegalovirus | UL122 | Beta Ge |
| CUST_P10002395 | 173456 | 173514 | 1831 | CMV (HHV-5) Cytomegalovirus | UL122 | Beta Ge |
| CUST_P10002396 | 173503 | 173553 | 1832 | CMV (HHV-5) Cytomegalovirus | UL122 | Beta Ge |
| CUST_P10002397 | 173520 | 173579 | 1833 | CMV (HHV-5) Cytomegalovirus | UL122 | Beta Ge |
| CUST_P10002398 | 173555 | 173613 | 1834 | CMV (HHV-5) Cytomegalovirus | UL122 | Beta Ge |
| CUST_P10002399 | 173596 | 173649 | 1835 | CMV (HHV-5) Cytomegalovirus | UL122 | Beta Ge |
| CUST_P10002400 | 173621 | 173679 | 1836 | CMV (HHV-5) Cytomegalovirus | UL122 | Beta Ge |
| CUST_P10002401 | 173674 | 173731 | 1837 | CMV (HHV-5) Cytomegalovirus | UL122 | Beta Ge |
| CUST_P10002402 | 173693 | 173746 | 1838 | CMV (HHV-5) Cytomegalovirus | UL122 | Beta Ge |
| CUST_P10002403 | 173735 | 173780 | 1839 | CMV (HHV-5) Cytomegalovirus | UL122 | Beta Ge |
| CUST_P10002404 | 173766 | 173812 | 1840 | CMV (HHV-5) Cytomegalovirus | UL122 | Beta Ge |
| CUST_P10002406 | 174051 | 174095 | 1841 | CMV (HHV-5) Cytomegalovirus | UL122 | Beta Ge |
| CUST_P10002407 | 174065 | 174109 | 1842 | CMV (HHV-5) Cytomegalovirus | UL123 | Prot E |
| CUST_P10002408 | 174215 | 174259 | 1843 | CMV (HHV-5) Cytomegalovirus | UL123 | Prot E |
| CUST_P10002411 | 174671 | 174726 | 1844 | CMV (HHV-5) Cytomegalovirus | UL124 | Prot E |
| CUST_P10002466 | 178473 | 178527 | 1845 | CMV (HHV-5) Cytomegalovirus | UL132 | Glyco |
| CUST_P10002470 | 178801 | 178851 | 1846 | CMV (HHV-5) Cytomegalovirus | UL132 | Glyco |
| CUST_P10002471 | 178825 | 178870 | 1847 | CMV (HHV-5) Cytomegalovirus | UL132 | Glyco |
| CUST_P10002474 | 178926 | 178974 | 1848 | CMV (HHV-5) Cytomegalovirus | UL132 | Glyco |
| CUST_P10002475 | 178954 | 179000 | 1849 | CMV (HHV-5) Cytomegalovirus | UL132 | Glyco |
| CUST_P10002927 | 211545 | 211592 | 1850 | CMV (HHV-5) Cytomegalovirus | US17 | protein |
| CUST_P10002930 | 211944 | 211988 | 1851 | CMV (HHV-5) Cytomegalovirus | US17 | protein |
| CUST_P10002934 | 212083 | 212127 | 1852 | CMV (HHV-5) Cytomegalovirus | US17 | protein |
| CUST_P10003273 | 1 | 60 | 1853 | Human herpesvirus 4 (EBV), B95-8 | LMP-2A | transmembrane protein |
| CUST_P10003278 | 444 | 503 | 1854 | Human herpesvirus 4 (EBV), B95-8 | LMP-2A | transmembrane protein |
| CUST_P10003289 | 1435 | 1487 | 1855 | Human herpesvirus 4 (EBV), B95-8 | LMP-2A | transmembrane protein |
| CUST_P10003301 | 2062 | 2106 | 1856 | Human herpesvirus 4 (EBV), B95-8 | BNFR1 | tegument protein |
| CUST_P10003303 | 2221 | 2265 | 1857 | Human herpesvirus 4 (EBV), B95-8 | BNFR1 | tegument protein |
| CUST_P10003307 | 2620 | 2664 | 1858 | Human herpesvirus 4 (EBV), B95-8 | BNFR1 | tegument protein |
| CUST_P10003313 | 3104 | 3148 | 1859 | Human herpesvirus 4 (EBV), B95-8 | BNFR1 | tegument protein |
| CUST_P10003322 | 3928 | 3972 | 1860 | Human herpesvirus 4 (EBV), B95-8 | BNFR1 | tegument protein |
| CUST_P10003342 | 5201 | 5245 | 1861 | Human herpesvirus 4 (EBV), B95-8 | BNFR1 | tegument protein |
| CUST_P10003349 | 5834 | 5893 | 1862 | Human herpesvirus 4 (EBV), B95-8 | BNFR1 | tegument protein |
| CUST_P10003351 | 5931 | 5985 | 1863 | Human herpesvirus 4 (EBV), B95-8 | EBNA-1 | Nuclear antigen |

TABLE 8-continued

Exemplary DNA virus probes

| ProbeID | Start | End | SEQ ID NO: | Virus | Genomic Region | Product |
|---|---|---|---|---|---|---|
| CUST_P10003352 | 6010 | 6069 | 1864 | Human herpesvirus 4 (EBV), B95-8 | EBNA-1 | Nuclear antigen |
| CUST_P10003367 | 7289 | 7347 | 1865 | Human herpesvirus 4 (EBV), B95-8 | EBNA-1 | Nuclear antigen |
| CUST_P10003369 | 7409 | 7468 | 1866 | Human herpesvirus 4 (EBV), B95-8 | EBNA-1 | Nuclear antigen |
| CUST_P10003372 | 7520 | 7579 | 1867 | Human herpesvirus 4 (EBV), B95-8 | EBNA-1 | Nuclear antigen |
| CUST_P10003375 | 7605 | 7664 | 1868 | Human herpesvirus 4 (EBV), B95-8 | EBNA-1 | Nuclear antigen |
| CUST_P10003376 | 7635 | 7694 | 1869 | Human herpesvirus 4 (EBV), B95-8 | EBNA-1 | Nuclear antigen |
| CUST_P10003377 | 7706 | 7765 | 1870 | Human herpesvirus 4 (EBV), B95-8 | EBNA-1 | Nuclear antigen |
| CUST_P10003378 | 7731 | 7790 | 1871 | Human herpesvirus 4 (EBV), B95-8 | EBNA-1 | Nuclear antigen |
| CUST_P10003379 | 7786 | 7845 | 1872 | Human herpesvirus 4 (EBV), B95-8 | EBNA-1 | Nuclear antigen |
| CUST_P10003380 | 7821 | 7880 | 1873 | Human herpesvirus 4 (EBV), B95-8 | EBNA-1 | Nuclear antigen |
| CUST_P10003381 | 7871 | 7930 | 1874 | Human herpesvirus 4 (EBV), B95-8 | EBNA-1 | Nuclear antigen |
| CUST_P10003382 | 7901 | 7960 | 1875 | Human herpesvirus 4 (EBV), B95-8 | EBNA-1 | Nuclear antigen |
| CUST_P10003383 | 7941 | 8000 | 1876 | Human herpesvirus 4 (EBV), B95-8 | EBNA-1 | Nuclear antigen |
| CUST_P10003384 | 8000 | 8051 | 1877 | Human herpesvirus 4 (EBV), B95-8 | EBNA-1 | Nuclear antigen |
| CUST_P10003390 | 8236 | 8291 | 1878 | Human herpesvirus 4 (EBV), B95-8 | EBNA-1 | Nuclear antigen |
| CUST_P10003398 | 8631 | 8690 | 1879 | Human herpesvirus 4 (EBV), B95-8 | EBNA-1 | Nuclear antigen |
| CUST_P10003399 | 8659 | 8716 | 1880 | Human herpesvirus 4 (EBV), B95-8 | EBNA-1 | Nuclear antigen |
| CUST_P10003400 | 8690 | 8737 | 1881 | Human herpesvirus 4 (EBV), B95-8 | EBNA-1 | Nuclear antigen |
| CUST_P10003404 | 9006 | 9063 | 1882 | Human herpesvirus 4 (EBV), B95-8 | EBNA-1 | Nuclear antigen |
| CUST_P10003405 | 9052 | 9111 | 1883 | Human herpesvirus 4 (EBV), B95-8 | EBNA-1 | Nuclear antigen |
| CUST_P10003406 | 9110 | 9166 | 1884 | Human herpesvirus 4 (EBV), B95-8 | EBNA-1 | Nuclear antigen |
| CUST_P10003408 | 9301 | 9350 | 1885 | Human herpesvirus 4 (EBV), B95-8 | EBNA-1 | Nuclear antigen |
| CUST_P10003409 | 9349 | 9399 | 1886 | Human herpesvirus 4 (EBV), B95-8 | EBNA-1 | Nuclear antigen |
| CUST_P10003412 | 9759 | 9811 | 1887 | Human herpesvirus 4 (EBV), B95-8 | EBNA-1 | Nuclear antigen |
| CUST_P10003413 | 9788 | 9841 | 1888 | Human herpesvirus 4 (EBV), B95-8 | EBNA-1 | Nuclear antigen |
| CUST_P10003418 | 9961 | 10012 | 1889 | Human herpesvirus 4 (EBV), B95-8 | EBNA-1 | Nuclear antigen |
| CUST_P10003427 | 10915 | 10966 | 1890 | Human herpesvirus 4 (EBV), B95-8 | EBNA-1 | Nuclear antigen |
| CUST_P10003429 | 10994 | 11046 | 1891 | Human herpesvirus 4 (EBV), B95-8 | EBNA-1 | Nuclear antigen |
| CUST_P10003432 | 11304 | 11362 | 1892 | Human herpesvirus 4 (EBV), B95-8 | EBNA-1 | Nuclear antigen |
| CUST_P10003721 | 35383 | 35442 | 1893 | Human herpesvirus 4 (EBV), B95-8 | EBNA-1 | Nuclear antigen |
| CUST_P10003725 | 35654 | 35708 | 1894 | Human herpesvirus 4 (EBV), B95-8 | EBNA-1 | Nuclear antigen |
| CUST_P10005257 | 152676 | 152720 | 1895 | Human herpesvirus 4 (EBV), B95-8 | BALF5 | Binding Protein |
| CUST_P10005266 | 153637 | 153681 | 1896 | Human herpesvirus 4 (EBV), B95-8 | BALF5 | Binding Protein |
| CUST_P10005267 | 153658 | 153702 | 1897 | Human herpesvirus 4 (EBV), B95-8 | BALF5 | Binding Protein |
| CUST_P10005275 | 154346 | 154393 | 1898 | Human herpesvirus 4 (EBV), B95-8 | BALF5 | Binding Protein |
| CUST_P10005279 | 154462 | 154516 | 1899 | Human herpesvirus 4 (EBV), B95-8 | BALF5 | Binding Protein |
| CUST_P10005291 | 155318 | 155362 | 1900 | Human herpesvirus 4 (EBV), B95-8 | BALF5 | Binding Protein |

TABLE 8-continued

Exemplary DNA virus probes

| ProbeID | Start | End | SEQ ID NO: | Virus | Genomic Region | Product |
|---|---|---|---|---|---|---|
| CUST_P10005293 | 155583 | 155627 | 1901 | Human herpesvirus 4 (EBV), B95-8 | BALF5 | Binding Protein |
| CUST_P10005300 | 155914 | 155958 | 1902 | Human herpesvirus 4 (EBV), B95-8 | BALF5 | Binding Protein |
| CUST_P10005304 | 156254 | 156306 | 1903 | Human herpesvirus 4 (EBV), B95-8 | BALF5 | Binding Protein |
| CUST_P10005325 | 157914 | 157963 | 1904 | Human herpesvirus 4 (EBV), B95-8 | BALF4 | Binding Protein |
| CUST_P10005327 | 158072 | 158121 | 1905 | Human herpesvirus 4 (EBV), B95-8 | BALF4 | Binding Protein |
| CUST_P10005329 | 158133 | 158183 | 1906 | Human herpesvirus 4 (EBV), B95-8 | BALF4 | Binding Protein |
| CUST_P10005332 | 158230 | 158286 | 1907 | Human herpesvirus 4 (EBV), B95-8 | BALF4 | Binding Protein |
| CUST_P10005334 | 158408 | 158453 | 1908 | Human herpesvirus 4 (EBV), B95-8 | BALF4 | Binding Protein |
| CUST_P10005335 | 158572 | 158625 | 1909 | Human herpesvirus 4 (EBV), B95-8 | BALF4 | Binding Protein |
| CUST_P10005336 | 158595 | 158644 | 1910 | Human herpesvirus 4 (EBV), B95-8 | BALF4 | Binding Protein |
| CUST_P10005340 | 158865 | 158916 | 1911 | Human herpesvirus 4 (EBV), B95-8 | BALF4 | Binding Protein |
| CUST_P10005355 | 160486 | 160545 | 1912 | Human herpesvirus 4 (EBV), B95-8 | BALF4 | Binding Protein |
| CUST_P10005356 | 160515 | 160574 | 1913 | Human herpesvirus 4 (EBV), B95-8 | BALF3 | Binding Protein |
| CUST_P10005367 | 161267 | 161318 | 1914 | Human herpesvirus 4 (EBV), B95-8 | BALF3 | Binding Protein |
| CUST_P10005380 | 162040 | 162086 | 1915 | Human herpesvirus 4 (EBV), B95-8 | BALF3 | Binding Protein |
| CUST_P10005381 | 162117 | 162161 | 1916 | Human herpesvirus 4 (EBV), B95-8 | BALF3 | Binding Protein |
| CUST_P10005382 | 162322 | 162366 | 1917 | Human herpesvirus 4 (EBV), B95-8 | BALF3 | Binding Protein |
| CUST_P10005496 | 1 | 60 | 1918 | Human herpesvirus 4 (EBV), AG876 | LMP-2B | latency and B cell survival |
| CUST_P10005503 | 903 | 961 | 1919 | Human herpesvirus 4 (EBV), AG876 | LMP-2B | latency and B cell survival |
| CUST_P10005506 | 1162 | 1221 | 1920 | Human herpesvirus 4 (EBV), AG876 | LMP-2B | latency and B cell survival |
| CUST_P10005507 | 1290 | 1345 | 1921 | Human herpesvirus 4 (EBV), AG876 | LMP-2B | latency and B cell survival |
| CUST_P10005515 | 1658 | 1717 | 1922 | Human herpesvirus 4 (EBV), AG876 | LMP-2B | latency and B cell survival |
| CUST_P10005567 | 5833 | 5892 | 1923 | Human herpesvirus 4 (EBV), AG876 | EBER-1 | DNA replication |
| CUST_P10005568 | 5869 | 5928 | 1924 | Human herpesvirus 4 (EBV), AG876 | EBER-1 | DNA replication |
| CUST_P10005571 | 6014 | 6073 | 1925 | Human herpesvirus 4 (EBV), AG876 | EBER-1 | DNA replication |
| CUST_P10005581 | 6584 | 6635 | 1926 | Human herpesvirus 4 (EBV), AG876 | EBER-1 | DNA replication |
| CUST_P10005585 | 6912 | 6967 | 1927 | Human herpesvirus 4 (EBV), AG876 | EBER-1 | DNA replication |
| CUST_P10005589 | 7293 | 7348 | 1928 | Human herpesvirus 4 (EBV), AG876 | EBER-1 | DNA replication |
| CUST_P10005592 | 7417 | 7476 | 1929 | Human herpesvirus 4 (EBV), AG876 | EBER-1 | DNA replication |
| CUST_P10005593 | 7470 | 7529 | 1930 | Human herpesvirus 4 (EBV), AG876 | EBER-1 | DNA replication |
| CUST_P10005594 | 7520 | 7579 | 1931 | Human herpesvirus 4 (EBV), AG876 | EBER-1 | DNA replication |
| CUST_P10005595 | 7590 | 7649 | 1932 | Human herpesvirus 4 (EBV), AG876 | EBER-1 | DNA replication |
| CUST_P10005596 | 7615 | 7674 | 1933 | Human herpesvirus 4 (EBV), AG876 | EBER-1 | DNA replication |
| CUST_P10005597 | 7645 | 7704 | 1934 | Human herpesvirus 4 (EBV), AG876 | EBER-1 | DNA replication |
| CUST_P10005598 | 7701 | 7760 | 1935 | Human herpesvirus 4 (EBV), AG876 | EBER-1 | DNA replication |
| CUST_P10005599 | 7740 | 7799 | 1936 | Human herpesvirus 4 (EBV), AG876 | EBER-1 | DNA replication |

TABLE 8-continued

Exemplary DNA virus probes

| ProbeID | Start | End | SEQ ID NO: | Virus | Genomic Region | Product |
|---|---|---|---|---|---|---|
| CUST_P10005600 | 7770 | 7829 | 1937 | Human herpesvirus 4 (EBV), AG876 | EBER-1 | DNA replication |
| CUST_P10005601 | 7799 | 7858 | 1938 | Human herpesvirus 4 (EBV), AG876 | EBER-1 | DNA replication |
| CUST_P10005602 | 7835 | 7894 | 1939 | Human herpesvirus 4 (EBV), AG876 | EBER-1 | DNA replication |
| CUST_P10005604 | 7910 | 7969 | 1940 | Human herpesvirus 4 (EBV), AG876 | EBER-1 | DNA replication |
| CUST_P10005605 | 7940 | 7999 | 1941 | Human herpesvirus 4 (EBV), AG876 | EBER-1 | DNA replication |
| CUST_P10005606 | 7972 | 8031 | 1942 | Human herpesvirus 4 (EBV), AG876 | EBER-1 | DNA replication |
| CUST_P10005617 | 8432 | 8486 | 1943 | Human herpesvirus 4 (EBV), AG876 | EBER-1 | DNA replication |
| CUST_P10005619 | 8501 | 8560 | 1944 | Human herpesvirus 4 (EBV), AG876 | EBER-1 | DNA replication |
| CUST_P10005620 | 8536 | 8590 | 1945 | Human herpesvirus 4 (EBV), AG876 | EBER-1 | DNA replication |
| CUST_P10005622 | 8614 | 8673 | 1946 | Human herpesvirus 4 (EBV), AG876 | EBER-1 | DNA replication |
| CUST_P10005623 | 8647 | 8706 | 1947 | Human herpesvirus 4 (EBV), AG876 | EBER-1 | DNA replication |
| CUST_P10005626 | 8996 | 9052 | 1948 | Human herpesvirus 4 (EBV), AG876 | EBER-1 | DNA replication |
| CUST_P10005627 | 9041 | 9100 | 1949 | Human herpesvirus 4 (EBV), AG876 | EBER-1 | DNA replication |
| CUST_P10005628 | 9096 | 9149 | 1950 | Human herpesvirus 4 (EBV), AG876 | EBER-1 | DNA replication |
| CUST_P10005635 | 9782 | 9837 | 1951 | Human herpesvirus 4 (EBV), AG876 | BCRF1 | Early protein |
| CUST_P10005640 | 9942 | 9995 | 1952 | Human herpesvirus 4 (EBV), AG876 | BCRF1 | Early protein |
| CUST_P10005641 | 10139 | 10194 | 1953 | Human herpesvirus 4 (EBV), AG876 | BCRF1 | Early protein |
| CUST_P10005654 | 11289 | 11348 | 1954 | Human herpesvirus 4 (EBV), AG876 | BCRF1 | Early protein |
| CUST_P10005661 | 11661 | 11720 | 1955 | Human herpesvirus 4 (EBV), AG876 | IR1 | Repeat Sequence |
| CUST_P10005662 | 11765 | 11824 | 1956 | Human herpesvirus 4 (EBV), AG876 | IR1 | Repeat Sequence |
| CUST_P10005663 | 11948 | 11999 | 1957 | Human herpesvirus 4 (EBV), AG876 | IR1 | Repeat Sequence |
| CUST_P10005933 | 35619 | 35674 | 1958 | Human herpesvirus 4 (EBV), AG876 | EBNA-2 | Nuclear antigen |
| CUST_P10005934 | 35650 | 35709 | 1959 | Human herpesvirus 4 (EBV), AG876 | EBNA-2 | Nuclear antigen |
| CUST_P10005935 | 35773 | 35832 | 1960 | Human herpesvirus 4 (EBV), AG876 | EBNA-2 | Nuclear antigen |
| CUST_P10005941 | 36221 | 36277 | 1961 | Human herpesvirus 4 (EBV), AG876 | EBNA-2 | Nuclear antigen |
| CUST_P10005943 | 36301 | 36360 | 1962 | Human herpesvirus 4 (EBV), AG876 | EBNA-2 | Nuclear antigen |
| CUST_P10005961 | 37425 | 37477 | 1963 | Human herpesvirus 4 (EBV), AG876 | EBNA-2 | Nuclear antigen |
| CUST_P10005962 | 37566 | 37625 | 1964 | Human herpesvirus 4 (EBV), AG876 | EBNA-2 | Nuclear antigen |
| CUST_P10005965 | 37982 | 38041 | 1965 | Human herpesvirus 4 (EBV), AG876 | EBNA-2 | Nuclear antigen |
| CUST_P10005981 | 41069 | 41128 | 1966 | Human herpesvirus 4 (EBV), AG876 | BFLF2 | Nuclear antigen |
| CUST_P10005994 | 42062 | 42114 | 1967 | Human herpesvirus 4 (EBV), AG876 | BFLF2 | Nuclear antigen |
| CUST_P10005995 | 42170 | 42229 | 1968 | Human herpesvirus 4 (EBV), AG876 | BFLF2 | Nuclear antigen |
| CUST_P10005996 | 42338 | 42397 | 1969 | Human herpesvirus 4 (EBV), AG876 | BFLF2 | Nuclear antigen |
| CUST_P10005997 | 42368 | 42427 | 1970 | Human herpesvirus 4 (EBV), AG876 | BFLF2 | Nuclear antigen |
| CUST_P10005998 | 42421 | 42480 | 1971 | Human herpesvirus 4 (EBV), AG876 | BFLF2 | Nuclear antigen |
| CUST_P10006001 | 42542 | 42594 | 1972 | Human herpesvirus 4 (EBV), AG876 | BFLF2 | Nuclear antigen |
| CUST_P10006009 | 43272 | 43331 | 1973 | Human herpesvirus 4 (EBV), AG876 | BFLF2 | Nuclear antigen |
| CUST_P10006010 | 43296 | 43355 | 1974 | Human herpesvirus 4 (EBV), AG876 | BFLF2 | Nuclear antigen |
| CUST_P10006011 | 43322 | 43381 | 1975 | Human herpesvirus 4 (EBV), AG876 | BFLF2 | Nuclear antigen |

TABLE 8-continued

Exemplary DNA virus probes

| ProbeID | Start | End | SEQ ID NO: | Virus | Genomic Region | Product |
|---|---|---|---|---|---|---|
| CUST_P10006026 | 44210 | 44266 | 1976 | Human herpesvirus 4 (EBV), AG876 | BFLF2 | Nuclear antigen |
| CUST_P10006062 | 46628 | 46687 | 1977 | Human herpesvirus 4 (EBV), AG876 | BFLF2 | Nuclear antigen |
| CUST_P10006104 | 49867 | 49926 | 1978 | Human herpesvirus 4 (EBV), AG876 | BFLF2 | Nuclear antigen |
| CUST_P10006292 | 64392 | 64446 | 1979 | Human herpesvirus 4 (EBV), AG876 | BARF1 | Protein |
| CUST_P10006337 | 67573 | 67632 | 1980 | Human herpesvirus 4 (EBV), AG876 | BARF1 | Protein |
| CUST_P10006338 | 67734 | 67780 | 1981 | Human herpesvirus 4 (EBV), AG876 | BARF1 | Protein |
| CUST_P10006346 | 68303 | 68351 | 1982 | Human herpesvirus 4 (EBV), AG876 | BARF1 | Protein |
| CUST_P10006354 | 68922 | 68968 | 1983 | Human herpesvirus 4 (EBV), AG876 | BARF1 | Protein |
| CUST_P10006495 | 79411 | 79470 | 1984 | Human herpesvirus 4 (EBV), AG876 | EBNA-3C | Protein |
| CUST_P10006496 | 79445 | 79504 | 1985 | Human herpesvirus 4 (EBV), AG876 | EBNA-3C | Protein |
| CUST_P10006497 | 79520 | 79575 | 1986 | Human herpesvirus 4 (EBV), AG876 | EBNA-3C | Protein |
| CUST_P10006499 | 79742 | 79801 | 1987 | Human herpesvirus 4 (EBV), AG876 | EBNA-3C | Protein |
| CUST_P10006506 | 80288 | 80346 | 1988 | Human herpesvirus 4 (EBV), AG876 | EBNA-3C | Protein |
| CUST_P10006513 | 80822 | 80881 | 1989 | Human herpesvirus 4 (EBV), AG876 | EBNA-3C | Protein |
| CUST_P10006515 | 80901 | 80955 | 1990 | Human herpesvirus 4 (EBV), AG876 | EBNA-3C | Protein |
| CUST_P10006542 | 83005 | 83064 | 1991 | Human herpesvirus 4 (EBV), AG876 | EBNA-3C | Protein |
| CUST_P10006547 | 83394 | 83446 | 1992 | Human herpesvirus 4 (EBV), AG876 | EBNA-3C | Protein |
| CUST_P10006549 | 83520 | 83575 | 1993 | Human herpesvirus 4 (EBV), AG876 | EBNA-3C | Protein |
| CUST_P10006559 | 84220 | 84279 | 1994 | Human herpesvirus 4 (EBV), AG876 | EBNA-3C | Protein |
| CUST_P10006560 | 84245 | 84304 | 1995 | Human herpesvirus 4 (EBV), AG876 | EBNA-3C | Protein |
| CUST_P10006562 | 84360 | 84419 | 1996 | Human herpesvirus 4 (EBV), AG876 | EBNA-3C | Protein |
| CUST_P10006563 | 84394 | 84453 | 1997 | Human herpesvirus 4 (EBV), AG876 | EBNA-3C | Protein |
| CUST_P10006619 | 87106 | 87160 | 1998 | Human herpesvirus 4 (EBV), AG876 | EBNA-3C | Protein |
| CUST_P10006629 | 87723 | 87782 | 1999 | Human herpesvirus 4 (EBV), AG876 | EBNA-3C | Protein |
| CUST_P10006659 | 90250 | 90309 | 2000 | Human herpesvirus 4 (EBV), AG876 | EBNA-3C | Protein |
| CUST_P10006735 | 95481 | 95540 | 2001 | Human herpesvirus 4 (EBV), AG876 | EBNA-3C | Protein |
| CUST_P10006749 | 96426 | 96485 | 2002 | Human herpesvirus 4 (EBV), AG876 | EBNA-3C | Protein |
| CUST_P10006975 | 114037 | 114096 | 2003 | Human herpesvirus 4 (EBV), AG876 | BZLF1 | Transcription factor |
| CUST_P10007058 | 119518 | 119568 | 2004 | Human herpesvirus 4 (EBV), AG876 | BZLF1 | Transcription factor |
| CUST_P10007154 | 127252 | 127301 | 2005 | Human herpesvirus 4 (EBV), AG876 | BZLF1 | Transcription factor |
| CUST_P10007332 | 140366 | 140418 | 2006 | Human herpesvirus 4 (EBV), AG876 | BRRF1 | Early Protein |
| CUST_P10007342 | 141133 | 141189 | 2007 | Human herpesvirus 4 (EBV), AG876 | BRRF1 | Early Protein |
| CUST_P10007350 | 141491 | 141550 | 2008 | Human herpesvirus 4 (EBV), AG876 | BRRF1 | Early Protein |
| CUST_P10007368 | 146390 | 146444 | 2009 | Human herpesvirus 4 (EBV), AG876 | BRRF1 | Early Protein |
| CUST_P10007370 | 146461 | 146520 | 2010 | Human herpesvirus 4 (EBV), AG876 | BRRF1 | Early Protein |
| CUST_P10007371 | 146485 | 146544 | 2011 | Human herpesvirus 4 (EBV), AG876 | BRRF1 | Early Protein |
| CUST_P10007385 | 147651 | 147710 | 2012 | Human herpesvirus 4 (EBV), AG876 | BRRF1 | Early Protein |
| CUST_P10007389 | 147919 | 147978 | 2013 | Human herpesvirus 4 (EBV), AG876 | BRRF1 | Early Protein |
| CUST_P10007496 | 155451 | 155495 | 2014 | Human herpesvirus 4 (EBV), AG876 | BALF5 | Pol |
| CUST_P10007497 | 155595 | 155639 | 2015 | Human herpesvirus 4 (EBV), AG876 | BALF5 | Pol |
| CUST_P10007498 | 155833 | 155878 | 2016 | Human herpesvirus 4 (EBV), AG876 | BALF5 | Pol |
| CUST_P10007499 | 155874 | 155918 | 2017 | Human herpesvirus 4 (EBV), AG876 | BALF5 | Pol |
| CUST_P10007511 | 156741 | 156785 | 2018 | Human herpesvirus 4 (EBV), AG876 | BALF5 | Pol |
| CUST_P10007512 | 156802 | 156846 | 2019 | Human herpesvirus 4 (EBV), AG876 | BALF5 | Pol |
| CUST_P10007519 | 157248 | 157292 | 2020 | Human herpesvirus 4 (EBV), AG876 | BALF5 | Pol |
| CUST_P10007686 | 169787 | 169844 | 2021 | Human herpesvirus 4 (EBV), AG876 | BALF4 | Pol |
| CUST_P10007687 | 169910 | 169964 | 2022 | Human herpesvirus 4 (EBV), AG876 | BALF4 | Pol |
| CUST_P10007688 | 169977 | 170032 | 2023 | Human herpesvirus 4 (EBV), AG876 | BALF4 | Pol |
| CUST_P10007838 | 8641 | 8685 | 2024 | Human herpesvirus 8 (HHV-8) | UL27 | Core |
| CUST_P10007845 | 9121 | 9173 | 2025 | Human herpesvirus 8 (HHV-8) | UL27 | Core |
| CUST_P10007846 | 9136 | 9192 | 2026 | Human herpesvirus 8 (HHV-8) | UL27 | Core |
| CUST_P10007847 | 9164 | 9219 | 2027 | Human herpesvirus 8 (HHV-8) | UL27 | Core |
| CUST_P10007848 | 9291 | 9338 | 2028 | Human herpesvirus 8 (HHV-8) | UL27 | Core |
| CUST_P10007849 | 9301 | 9352 | 2029 | Human herpesvirus 8 (HHV-8) | UL27 | Core |
| CUST_P10007850 | 9325 | 9380 | 2030 | Human herpesvirus 8 (HHV-8) | UL27 | Core |
| CUST_P10007859 | 10189 | 10234 | 2031 | Human herpesvirus 8 (HHV-8) | UL27 | Core |
| CUST_P10007861 | 10387 | 10436 | 2032 | Human herpesvirus 8 (HHV-8) | UL27 | Core |
| CUST_P10007862 | 10525 | 10584 | 2033 | Human herpesvirus 8 (HHV-8) | UL27 | Core |
| CUST_P10007865 | 10694 | 10743 | 2034 | Human herpesvirus 8 (HHV-8) | UL27 | Core |
| CUST_P10007870 | 11141 | 11191 | 2035 | Human herpesvirus 8 (HHV-8) | UL27 | Core |
| CUST_P10007871 | 11189 | 11243 | 2036 | Human herpesvirus 8 (HHV-8) | UL27 | Core |
| CUST_P10007875 | 11324 | 11370 | 2037 | Human herpesvirus 8 (HHV-8) | UL30 | DNA Pol |
| CUST_P10007882 | 11596 | 11644 | 2038 | Human herpesvirus 8 (HHV-8) | UL30 | DNA Pol |
| CUST_P10007889 | 12191 | 12244 | 2039 | Human herpesvirus 8 (HHV-8) | UL30 | DNA Pol |
| CUST_P10007890 | 12231 | 12276 | 2040 | Human herpesvirus 8 (HHV-8) | UL30 | DNA Pol |
| CUST_P10007892 | 12408 | 12453 | 2041 | Human herpesvirus 8 (HHV-8) | UL30 | DNA Pol |
| CUST_P10007894 | 12597 | 12642 | 2042 | Human herpesvirus 8 (HHV-8) | UL30 | DNA Pol |
| CUST_P10007895 | 12731 | 12786 | 2043 | Human herpesvirus 8 (HHV-8) | UL30 | DNA Pol |
| CUST_P10007896 | 12803 | 12855 | 2044 | Human herpesvirus 8 (HHV-8) | UL30 | DNA Pol |

TABLE 8-continued

Exemplary DNA virus probes

| ProbeID | Start | End | SEQ ID NO: | Virus | Genomic Region | Product |
|---|---|---|---|---|---|---|
| CUST_P10007900 | 13330 | 13383 | 2045 | Human herpesvirus 8 (HHV-8) | UL30 | DNA Pol |
| CUST_P10007902 | 13405 | 13449 | 2046 | Human herpesvirus 8 (HHV-8) | UL30 | DNA Pol |
| CUST_P10007903 | 13429 | 13473 | 2047 | Human herpesvirus 8 (HHV-8) | UL30 | DNA Pol |
| CUST_P10007906 | 13774 | 13821 | 2048 | Human herpesvirus 8 (HHV-8) | UL30 | DNA Pol |
| CUST_P10007907 | 13815 | 13859 | 2049 | Human herpesvirus 8 (HHV-8) | UL30 | DNA Pol |
| CUST_P10007910 | 14391 | 14438 | 2050 | Human herpesvirus 8 (HHV-8) | UL30 | DNA Pol |
| CUST_P10007912 | 14506 | 14551 | 2051 | Human herpesvirus 8 (HHV-8) | UL30 | DNA Pol |
| CUST_P10007915 | 14605 | 14655 | 2052 | Human herpesvirus 8 (HHV-8) | UL30 | DNA Pol |
| CUST_P10007916 | 14632 | 14686 | 2053 | Human herpesvirus 8 (HHV-8) | UL30 | DNA Pol |
| CUST_P10007921 | 15015 | 15062 | 2054 | Human herpesvirus 8 (HHV-8) | UL30 | DNA Pol |
| CUST_P10007922 | 15051 | 15095 | 2055 | Human herpesvirus 8 (HHV-8) | UL30 | DNA Pol |
| CUST_P10007923 | 15187 | 15232 | 2056 | Human herpesvirus 8 (HHV-8) | UL30 | DNA Pol |
| CUST_P10007925 | 15488 | 15536 | 2057 | Human herpesvirus 8 (HHV-8) | UL30 | DNA Pol |
| CUST_P10007929 | 15833 | 15879 | 2058 | Human herpesvirus 8 (HHV-8) | UL30 | DNA Pol |
| CUST_P10007933 | 16005 | 16057 | 2059 | Human herpesvirus 8 (HHV-8) | UL30 | DNA Pol |
| CUST_P10007936 | 16274 | 16324 | 2060 | Human herpesvirus 8 (HHV-8) | UL30 | DNA Pol |
| CUST_P10007937 | 16293 | 16350 | 2061 | Human herpesvirus 8 (HHV-8) | UL30 | DNA Pol |
| CUST_P10007942 | 16565 | 16614 | 2062 | Human herpesvirus 8 (HHV-8) | UL30 | DNA Pol |
| CUST_P10007943 | 16679 | 16733 | 2063 | Human herpesvirus 8 (HHV-8) | UL30 | DNA Pol |
| CUST_P10007944 | 16760 | 16804 | 2064 | Human herpesvirus 8 (HHV-8) | UL30 | DNA Pol |
| CUST_P10007946 | 16874 | 16922 | 2065 | Human herpesvirus 8 (HHV-8) | UL30 | DNA Pol |
| CUST_P10007947 | 17007 | 17064 | 2066 | Human herpesvirus 8 (HHV-8) | UL30 | DNA Pol |
| CUST_P10008350 | 47027 | 47078 | 2067 | Human herpesvirus 8 (HHV-8) | ORF26 | Capsid |
| CUST_P10008352 | 47180 | 47235 | 2068 | Human herpesvirus 8 (HHV-8) | ORF26 | Capsid |
| CUST_P10008353 | 47205 | 47256 | 2069 | Human herpesvirus 8 (HHV-8) | ORF26 | Capsid |
| CUST_P10008354 | 47279 | 47328 | 2070 | Human herpesvirus 8 (HHV-8) | ORF26 | Capsid |
| CUST_P10008355 | 47290 | 47343 | 2071 | Human herpesvirus 8 (HHV-8) | ORF26 | Capsid |
| CUST_P10008356 | 47379 | 47429 | 2072 | Human herpesvirus 8 (HHV-8) | ORF26 | Capsid |
| CUST_P10008357 | 47404 | 47448 | 2073 | Human herpesvirus 8 (HHV-8) | ORF26 | Capsid |
| CUST_P10008358 | 47526 | 47583 | 2074 | Human herpesvirus 8 (HHV-8) | ORF26 | Capsid |
| CUST_P10008362 | 47811 | 47857 | 2075 | Human herpesvirus 8 (HHV-8) | ORF26 | Capsid |
| CUST_P10008363 | 47833 | 47889 | 2076 | Human herpesvirus 8 (HHV-8) | ORF26 | Capsid |
| CUST_P10008367 | 48249 | 48296 | 2077 | Human herpesvirus 8 (HHV-8) | ORF27 | PolyA |
| CUST_P10008370 | 48367 | 48418 | 2078 | Human herpesvirus 8 (HHV-8) | ORF27 | PolyA |
| CUST_P10008371 | 48393 | 48441 | 2079 | Human herpesvirus 8 (HHV-8) | ORF27 | PolyA |
| CUST_P10008373 | 48456 | 48500 | 2080 | Human herpesvirus 8 (HHV-8) | ORF27 | PolyA |
| CUST_P10008374 | 48487 | 48538 | 2081 | Human herpesvirus 8 (HHV-8) | ORF27 | PolyA |
| CUST_P10008376 | 48548 | 48592 | 2082 | Human herpesvirus 8 (HHV-8) | ORF27 | PolyA |
| CUST_P10008377 | 48585 | 48643 | 2083 | Human herpesvirus 8 (HHV-8) | ORF27 | PolyA |
| CUST_P10008378 | 48655 | 48702 | 2084 | Human herpesvirus 8 (HHV-8) | ORF27 | PolyA |
| CUST_P10008380 | 48859 | 48918 | 2085 | Human herpesvirus 8 (HHV-8) | ORF27 | PolyA |
| CUST_P10009322 | 112342 | 112396 | 2086 | Human herpesvirus 8 (HHV-8) | ORF73 | PolyA |
| CUST_P10009323 | 112362 | 112421 | 2087 | Human herpesvirus 8 (HHV-8) | ORF73 | PolyA |
| CUST_P10009324 | 112390 | 112439 | 2088 | Human herpesvirus 8 (HHV-8) | ORF73 | PolyA |
| CUST_P10009462 | 123077 | 123124 | 2089 | Human herpesvirus 8 (HHV-8) | ORF73 | PolyA |
| CUST_P10009466 | 123331 | 123382 | 2090 | Human herpesvirus 8 (HHV-8) | ORF73 | PolyA |
| CUST_P10009467 | 123379 | 123425 | 2091 | Human herpesvirus 8 (HHV-8) | ORF73 | PolyA |
| CUST_P10009468 | 123391 | 123441 | 2092 | Human herpesvirus 8 (HHV-8) | ORF73 | PolyA |
| CUST_P10009469 | 123537 | 123593 | 2093 | Human herpesvirus 8 (HHV-8) | ORF73 | PolyA |
| CUST_P10009470 | 123611 | 123664 | 2094 | Human herpesvirus 8 (HHV-8) | ORF73 | PolyA |
| CUST_P10009471 | 123635 | 123692 | 2095 | Human herpesvirus 8 (HHV-8) | ORF73 | PolyA |
| CUST_P10009472 | 123655 | 123714 | 2096 | Human herpesvirus 8 (HHV-8) | ORF73 | PolyA |
| CUST_P10009473 | 123682 | 123736 | 2097 | Human herpesvirus 8 (HHV-8) | ORF73 | PolyA |
| CUST_P10009474 | 123710 | 123769 | 2098 | Human herpesvirus 8 (HHV-8) | ORF73 | PolyA |
| CUST_P10009475 | 123738 | 123788 | 2099 | Human herpesvirus 8 (HHV-8) | ORF73 | PolyA |
| CUST_P10009482 | 124109 | 124164 | 2100 | Human herpesvirus 8 (HHV-8) | ORF73 | PolyA |
| CUST_P10009484 | 124384 | 124437 | 2101 | Human herpesvirus 8 (HHV-8) | ORF73 | PolyA |
| CUST_P10009486 | 124635 | 124686 | 2102 | Human herpesvirus 8 (HHV-8) | ORF73 | PolyA |
| CUST_P10009487 | 124654 | 124707 | 2103 | Human herpesvirus 8 (HHV-8) | ORF73 | PolyA |
| CUST_P10009488 | 124679 | 124723 | 2104 | Human herpesvirus 8 (HHV-8) | ORF73 | PolyA |
| CUST_P10009489 | 126493 | 126541 | 2105 | Human herpesvirus 8 (HHV-8) | ORF73 | PolyA |
| CUST_P10009493 | 126960 | 127005 | 2106 | Human herpesvirus 8 (HHV-8) | ORF73 | PolyA |
| CUST_P10009503 | 127324 | 127368 | 2107 | Human herpesvirus 8 (HHV-8) | ORF73 | PolyA |
| CUST_P10009504 | 127347 | 127395 | 2108 | Human herpesvirus 8 (HHV-8) | ORF73 | PolyA |
| CUST_P10009640 | 3 | 59 | 2109 | Human papillomavirus type 6b (HPV 6b) | E6 | Regulatory Protein |
| CUST_P10009641 | 34 | 85 | 2110 | Human papillomavirus type 6b (HPV 6b) | E6 | Regulatory Protein |
| CUST_P10009642 | 57 | 116 | 2111 | Human papillomavirus type 6b (HPV 6b) | E6 | Regulatory Protein |
| CUST_P10009644 | 148 | 207 | 2112 | Human papillomavirus type 6b (HPV 6b) | E6 | Regulatory Protein |

TABLE 8-continued

Exemplary DNA virus probes

| ProbeID | Start | End | SEQ ID NO: | Virus | Genomic Region | Product |
|---|---|---|---|---|---|---|
| CUST_P10009645 | 207 | 266 | 2113 | Human papillomavirus type 6b (HPV 6b) | E6 | Regulatory Protein |
| CUST_P10009646 | 347 | 406 | 2114 | Human papillomavirus type 6b (HPV 6b) | E6 | Regulatory Protein |
| CUST_P10009647 | 401 | 449 | 2115 | Human papillomavirus type 6b (HPV 6b) | E6 | Regulatory Protein |
| CUST_P10009648 | 527 | 582 | 2116 | Human papillomavirus type 6b (HPV 6b) | E6 | Regulatory Protein |
| CUST_P10009649 | 645 | 702 | 2117 | Human papillomavirus type 6b (HPV 6b) | E7 | Regulatory Protein |
| CUST_P10009651 | 952 | 1005 | 2118 | Human papillomavirus type 6b (HPV 6b) | E7 | Regulatory Protein |
| CUST_P10009652 | 975 | 1034 | 2119 | Human papillomavirus type 6b (HPV 6b) | E7 | Regulatory Protein |
| CUST_P10009654 | 1048 | 1099 | 2120 | Human papillomavirus type 6b (HPV 6b) | E1 | Regulatory Protein |
| CUST_P10009655 | 1079 | 1138 | 2121 | Human papillomavirus type 6b (HPV 6b) | E1 | Regulatory Protein |
| CUST_P10009656 | 1101 | 1160 | 2122 | Human papillomavirus type 6b (HPV 6b) | E1 | Regulatory Protein |
| CUST_P10009657 | 1140 | 1199 | 2123 | Human papillomavirus type 6b (HPV 6b) | E1 | Regulatory Protein |
| CUST_P10009658 | 1168 | 1221 | 2124 | Human papillomavirus type 6b (HPV 6b) | E1 | Regulatory Protein |
| CUST_P10009659 | 1204 | 1249 | 2125 | Human papillomavirus type 6b (HPV 6b) | E1 | Regulatory Protein |
| CUST_P10009660 | 1418 | 1477 | 2126 | Human papillomavirus type 6b (HPV 6b) | E1 | Regulatory Protein |
| CUST_P10009661 | 1492 | 1551 | 2127 | Human papillomavirus type 6b (HPV 6b) | E1 | Regulatory Protein |
| CUST_P10009662 | 1852 | 1908 | 2128 | Human papillomavirus type 6b (HPV 6b) | E1 | Regulatory Protein |
| CUST_P10009663 | 1899 | 1958 | 2129 | Human papillomavirus type 6b (HPV 6b) | E1 | Regulatory Protein |
| CUST_P10009664 | 2058 | 2117 | 2130 | Human papillomavirus type 6b (HPV 6b) | E1 | Regulatory Protein |
| CUST_P10009665 | 2086 | 2145 | 2131 | Human papillomavirus type 6b (HPV 6b) | E1 | Regulatory Protein |
| CUST_P10009666 | 2353 | 2412 | 2132 | Human papillomavirus type 6b (HPV 6b) | E1 | Regulatory Protein |
| CUST_P10009667 | 2463 | 2522 | 2133 | Human papillomavirus type 6b (HPV 6b) | E1 | Regulatory Protein |
| CUST_P10009668 | 2507 | 2566 | 2134 | Human papillomavirus type 6b (HPV 6b) | E1 | Regulatory Protein |
| CUST_P10009669 | 2554 | 2613 | 2135 | Human papillomavirus type 6b (HPV 6b) | E1 | Regulatory Protein |
| CUST_P10009670 | 2601 | 2660 | 2136 | Human papillomavirus type 6b (HPV 6b) | E1 | Regulatory Protein |
| CUST_P10009671 | 2686 | 2734 | 2137 | Human papillomavirus type 6b (HPV 6b) | E2 | Regulatory Protein |
| CUST_P10009672 | 2894 | 2946 | 2138 | Human papillomavirus type 6b (HPV 6b) | E2 | Regulatory Protein |
| CUST_P10009673 | 2916 | 2975 | 2139 | Human papillomavirus type 6b (HPV 6b) | E2 | Regulatory Protein |
| CUST_P10009674 | 2942 | 3001 | 2140 | Human papillomavirus type 6b (HPV 6b) | E2 | Regulatory Protein |
| CUST_P10009675 | 2963 | 3022 | 2141 | Human papillomavirus type 6b (HPV 6b) | E2 | Regulatory Protein |
| CUST_P10009676 | 3002 | 3061 | 2142 | Human papillomavirus type 6b (HPV 6b) | E2 | Regulatory Protein |
| CUST_P10009677 | 3030 | 3089 | 2143 | Human papillomavirus type 6b (HPV 6b) | E2 | Regulatory Protein |
| CUST_P10009678 | 3061 | 3120 | 2144 | Human papillomavirus type 6b (HPV 6b) | E2 | Regulatory Protein |
| CUST_P10009679 | 3091 | 3148 | 2145 | Human papillomavirus type 6b (HPV 6b) | E2 | Regulatory Protein |
| CUST_P10009680 | 3265 | 3324 | 2146 | Human papillomavirus type 6b (HPV 6b) | E2 | Regulatory Protein |
| CUST_P10009681 | 3305 | 3364 | 2147 | Human papillomavirus type 6b (HPV 6b) | E2 | Regulatory Protein |
| CUST_P10009686 | 3592 | 3651 | 2148 | Human papillomavirus type 6b (HPV 6b) | E2 | Regulatory Protein |

TABLE 8-continued

Exemplary DNA virus probes

| ProbeID | Start | End | SEQ ID NO: | Virus | Genomic Region | Product |
|---|---|---|---|---|---|---|
| CUST_P10009687 | 3614 | 3673 | 2149 | Human papillomavirus type 6b (HPV 6b) | E2 | Regulatory Protein |
| CUST_P10009689 | 3686 | 3740 | 2150 | Human papillomavirus type 6b (HPV 6b) | E2 | Regulatory Protein |
| CUST_P10009690 | 3724 | 3783 | 2151 | Human papillomavirus type 6b (HPV 6b) | E2 | Regulatory Protein |
| CUST_P10009691 | 3751 | 3810 | 2152 | Human papillomavirus type 6b (HPV 6b) | E2 | Regulatory Protein |
| CUST_P10009692 | 3937 | 3996 | 2153 | Human papillomavirus type 6b (HPV 6b) | E5 | Regulatory Protein |
| CUST_P10009693 | 4048 | 4107 | 2154 | Human papillomavirus type 6b (HPV 6b) | E5 | Regulatory Protein |
| CUST_P10009694 | 4077 | 4136 | 2155 | Human papillomavirus type 6b (HPV 6b) | E5 | Regulatory Protein |
| CUST_P10009695 | 4116 | 4175 | 2156 | Human papillomavirus type 6b (HPV 6b) | E5 | Regulatory Protein |
| CUST_P10009696 | 4140 | 4199 | 2157 | Human papillomavirus type 6b (HPV 6b) | E5 | Regulatory Protein |
| CUST_P10009697 | 4281 | 4340 | 2158 | Human papillomavirus type 6b (HPV 6b) | E5 | Regulatory Protein |
| CUST_P10009698 | 4505 | 4557 | 2159 | Human papillomavirus type 6b (HPV 6b) | L2 | Capsid |
| CUST_P10009702 | 4718 | 4773 | 2160 | Human papillomavirus type 6b (HPV 6b) | L2 | Capsid |
| CUST_P10009705 | 4804 | 4863 | 2161 | Human papillomavirus type 6b (HPV 6b) | L2 | Capsid |
| CUST_P10009706 | 4937 | 4991 | 2162 | Human papillomavirus type 6b (HPV 6b) | L2 | Capsid |
| CUST_P10009707 | 4970 | 5029 | 2163 | Human papillomavirus type 6b (HPV 6b) | L2 | Capsid |
| CUST_P10009709 | 5118 | 5175 | 2164 | Human papillomavirus type 6b (HPV 6b) | L2 | Capsid |
| CUST_P10009710 | 5237 | 5285 | 2165 | Human papillomavirus type 6b (HPV 6b) | L2 | Capsid |
| CUST_P10009711 | 5508 | 5567 | 2166 | Human papillomavirus type 6b (HPV 6b) | L2 | Capsid |
| CUST_P10009712 | 5568 | 5617 | 2167 | Human papillomavirus type 6b (HPV 6b) | L2 | Capsid |
| CUST_P10009713 | 5581 | 5640 | 2168 | Human papillomavirus type 6b (HPV 6b) | L2 | Capsid |
| CUST_P10009714 | 5611 | 5663 | 2169 | Human papillomavirus type 6b (HPV 6b) | L2 | Capsid |
| CUST_P10009715 | 5664 | 5716 | 2170 | Human papillomavirus type 6b (HPV 6b) | L2 | Capsid |
| CUST_P10009716 | 5699 | 5758 | 2171 | Human papillomavirus type 6b (HPV 6b) | L1 | PolyA |
| CUST_P10009717 | 5835 | 5893 | 2172 | Human papillomavirus type 6b (HPV 6b) | L1 | PolyA |
| CUST_P10009718 | 5882 | 5941 | 2173 | Human papillomavirus type 6b (HPV 6b) | L1 | PolyA |
| CUST_P10009719 | 5917 | 5971 | 2174 | Human papillomavirus type 6b (HPV 6b) | L1 | PolyA |
| CUST_P10009720 | 5980 | 6039 | 2175 | Human papillomavirus type 6b (HPV 6b) | L1 | PolyA |
| CUST_P10009721 | 6023 | 6077 | 2176 | Human papillomavirus type 6b (HPV 6b) | L1 | PolyA |
| CUST_P10009723 | 6106 | 6157 | 2177 | Human papillomavirus type 6b (HPV 6b) | L1 | PolyA |
| CUST_P10009724 | 6131 | 6190 | 2178 | Human papillomavirus type 6b (HPV 6b) | L1 | PolyA |
| CUST_P10009726 | 6346 | 6399 | 2179 | Human papillomavirus type 6b (HPV 6b) | L1 | PolyA |
| CUST_P10009727 | 6387 | 6446 | 2180 | Human papillomavirus type 6b (HPV 6b) | L1 | PolyA |
| CUST_P10009728 | 6426 | 6485 | 2181 | Human papillomavirus type 6b (HPV 6b) | L1 | PolyA |
| CUST_P10009729 | 6587 | 6641 | 2182 | Human papillomavirus type 6b (HPV 6b) | L1 | PolyA |
| CUST_P10009731 | 6661 | 6710 | 2183 | Human papillomavirus type 6b (HPV 6b) | L1 | PolyA |
| CUST_P10009732 | 6674 | 6727 | 2184 | Human papillomavirus type 6b (HPV 6b) | L1 | PolyA |

TABLE 8-continued

Exemplary DNA virus probes

| ProbeID | Start | End | SEQ ID NO: | Virus | Genomic Region | Product |
|---|---|---|---|---|---|---|
| CUST_P10009733 | 6713 | 6771 | 2185 | Human papillomavirus type 6b (HPV 6b) | L1 | PolyA |
| CUST_P10009734 | 6799 | 6858 | 2186 | Human papillomavirus type 6b (HPV 6b) | L1 | PolyA |
| CUST_P10009735 | 6914 | 6973 | 2187 | Human papillomavirus type 6b (HPV 6b) | L1 | PolyA |
| CUST_P10009736 | 7025 | 7070 | 2188 | Human papillomavirus type 6b (HPV 6b) | L1 | PolyA |
| CUST_P10009737 | 7146 | 7201 | 2189 | Human papillomavirus type 6b (HPV 6b) | L1 | PolyA |
| CUST_P10009739 | 7409 | 7456 | 2190 | Human papillomavirus type 6b (HPV 6b) |  | PolyA |
| CUST_P10009740 | 7560 | 7619 | 2191 | Human papillomavirus type 6b (HPV 6b) | ? | PolyA |
| CUST_P10009742 | 7703 | 7762 | 2192 | Human papillomavirus type 6b (HPV 6b) | ? | PolyA |
| CUST_P10009743 | 9 | 65 | 2193 | Human papillomavirus type 6b (HPV 11) | E6 | Regulatory Protein |
| CUST_P10009744 | 45 | 104 | 2194 | Human papillomavirus type 6b (HPV 11) | E6 | Regulatory Protein |
| CUST_P10009745 | 97 | 149 | 2195 | Human papillomavirus type 6b (HPV 11) | E6 | Regulatory Protein |
| CUST_P10009746 | 146 | 201 | 2196 | Human papillomavirus type 6b (HPV 11) | E6 | Regulatory Protein |
| CUST_P10009747 | 203 | 257 | 2197 | Human papillomavirus type 6b (HPV 11) | E6 | Regulatory Protein |
| CUST_P10009748 | 226 | 284 | 2198 | Human papillomavirus type 6b (HPV 11) | E6 | Regulatory Protein |
| CUST_P10009749 | 267 | 311 | 2199 | Human papillomavirus type 6b (HPV 11) | E6 | Regulatory Protein |
| CUST_P10009750 | 444 | 503 | 2200 | Human papillomavirus type 6b (HPV 11) | E6 | Regulatory Protein |
| CUST_P10009751 | 477 | 531 | 2201 | Human papillomavirus type 6b (HPV 11) | E6 | Regulatory Protein |
| CUST_P10009752 | 642 | 696 | 2202 | Human papillomavirus type 6b (HPV 11) | E7 | Regulatory Protein |
| CUST_P10009753 | 676 | 724 | 2203 | Human papillomavirus type 6b (HPV 11) | E7 | Regulatory Protein |
| CUST_P10009755 | 744 | 796 | 2204 | Human papillomavirus type 6b (HPV 11) | E7 | Regulatory Protein |
| CUST_P10009756 | 980 | 1039 | 2205 | Human papillomavirus type 6b (HPV 11) | E7 | Regulatory Protein |
| CUST_P10009758 | 1159 | 1212 | 2206 | Human papillomavirus type 6b (HPV 11) | E1 | Regulatory Protein |
| CUST_P10009759 | 1195 | 1242 | 2207 | Human papillomavirus type 6b (HPV 11) | E1 | Regulatory Protein |
| CUST_P10009760 | 1393 | 1452 | 2208 | Human papillomavirus type 6b (HPV 11) | E1 | Regulatory Protein |
| CUST_P10009761 | 1419 | 1478 | 2209 | Human papillomavirus type 6b (HPV 11) | E1 | Regulatory Protein |
| CUST_P10009762 | 1450 | 1509 | 2210 | Human papillomavirus type 6b (HPV 11) | E1 | Regulatory Protein |
| CUST_P10009763 | 1476 | 1535 | 2211 | Human papillomavirus type 6b (HPV 11) | E1 | Regulatory Protein |
| CUST_P10009765 | 1847 | 1899 | 2212 | Human papillomavirus type 6b (HPV 11) | E1 | Regulatory Protein |
| CUST_P10009766 | 1864 | 1923 | 2213 | Human papillomavirus type 6b (HPV 11) | E1 | Regulatory Protein |
| CUST_P10009767 | 1923 | 1982 | 2214 | Human papillomavirus type 6b (HPV 11) | E1 | Regulatory Protein |
| CUST_P10009768 | 1962 | 2017 | 2215 | Human papillomavirus type 6b (HPV 11) | E1 | Regulatory Protein |
| CUST_P10009769 | 2003 | 2062 | 2216 | Human papillomavirus type 6b (HPV 11) | E1 | Regulatory Protein |
| CUST_P10009770 | 2127 | 2186 | 2217 | Human papillomavirus type 6b (HPV 11) | E2 | Regulatory Protein |
| CUST_P10009771 | 2265 | 2316 | 2218 | Human papillomavirus type 6b (HPV 11) | E2 | Regulatory Protein |
| CUST_P10009772 | 2303 | 2362 | 2219 | Human papillomavirus type 6b (HPV 11) | E2 | Regulatory Protein |
| CUST_P10009773 | 2327 | 2384 | 2220 | Human papillomavirus type 6b (HPV 11) | E2 | Regulatory Protein |

TABLE 8-continued

Exemplary DNA virus probes

| ProbeID | Start | End | SEQ ID NO: | Virus | Genomic Region | Product |
|---|---|---|---|---|---|---|
| CUST_P10009774 | 2370 | 2420 | 2221 | Human papillomavirus type 6b (HPV 11) | E2 | Regulatory Protein |
| CUST_P10009775 | 2422 | 2481 | 2222 | Human papillomavirus type 6b (HPV 11) | E2 | Regulatory Protein |
| CUST_P10009776 | 2458 | 2517 | 2223 | Human papillomavirus type 6b (HPV 11) | E2 | Regulatory Protein |
| CUST_P10009777 | 2590 | 2649 | 2224 | Human papillomavirus type 6b (HPV 11) | E2 | Regulatory Protein |
| CUST_P10009778 | 2625 | 2684 | 2225 | Human papillomavirus type 6b (HPV 11) | E2 | Regulatory Protein |
| CUST_P10009779 | 2655 | 2708 | 2226 | Human papillomavirus type 6b (HPV 11) | E2 | Regulatory Protein |
| CUST_P10009780 | 2692 | 2740 | 2227 | Human papillomavirus type 6b (HPV 11) | E2 | Regulatory Protein |
| CUST_P10009781 | 2920 | 2979 | 2228 | Human papillomavirus type 6b (HPV 11) | E2 | Regulatory Protein |
| CUST_P10009782 | 2985 | 3035 | 2229 | Human papillomavirus type 6b (HPV 11) | E2 | Regulatory Protein |
| CUST_P10009783 | 3047 | 3106 | 2230 | Human papillomavirus type 6b (HPV 11) | E2 | Regulatory Protein |
| CUST_P10009784 | 3081 | 3140 | 2231 | Human papillomavirus type 6b (HPV 11) | E2 | Regulatory Protein |
| CUST_P10009785 | 3120 | 3176 | 2232 | Human papillomavirus type 6b (HPV 11) | E2 | Regulatory Protein |
| CUST_P10009786 | 3265 | 3324 | 2233 | Human papillomavirus type 6b (HPV 11) | E2 | Regulatory Protein |
| CUST_P10009787 | 3380 | 3424 | 2234 | Human papillomavirus type 6b (HPV 11) | E2 | Regulatory Protein |
| CUST_P10009788 | 3432 | 3476 | 2235 | Human papillomavirus type 6b (HPV 11) | E2 | Regulatory Protein |
| CUST_P10009789 | 3505 | 3560 | 2236 | Human papillomavirus type 6b (HPV 11) | E2 | Regulatory Protein |
| CUST_P10009790 | 3678 | 3735 | 2237 | Human papillomavirus type 6b (HPV 11) | E2 | Regulatory Protein |
| CUST_P10009791 | 3709 | 3768 | 2238 | Human papillomavirus type 6b (HPV 11) | E2 | Regulatory Protein |
| CUST_P10009792 | 3901 | 3960 | 2239 | Human papillomavirus type 6b (HPV 11) | E5 | Regulatory Protein |
| CUST_P10009793 | 4136 | 4195 | 2240 | Human papillomavirus type 6b (HPV 11) | E5 | Regulatory Protein |
| CUST_P10009794 | 4283 | 4342 | 2241 | Human papillomavirus type 6b (HPV 11) | E5 | Regulatory Protein |
| CUST_P10009795 | 4408 | 4458 | 2242 | Human papillomavirus type 6b (HPV 11) | E5 | Regulatory Protein |
| CUST_P10009796 | 4497 | 4556 | 2243 | Human papillomavirus type 6b (HPV 11) | L2 | Capsid |
| CUST_P10009798 | 4792 | 4851 | 2244 | Human papillomavirus type 6b (HPV 11) | L2 | Capsid |
| CUST_P10009799 | 4818 | 4875 | 2245 | Human papillomavirus type 6b (HPV 11) | L2 | Capsid |
| CUST_P10009800 | 4855 | 4912 | 2246 | Human papillomavirus type 6b (HPV 11) | L2 | Capsid |
| CUST_P10009802 | 4936 | 4993 | 2247 | Human papillomavirus type 6b (HPV 11) | L2 | Capsid |
| CUST_P10009804 | 5164 | 5223 | 2248 | Human papillomavirus type 6b (HPV 11) | L2 | Capsid |
| CUST_P10009805 | 5341 | 5397 | 2249 | Human papillomavirus type 6b (HPV 11) | L2 | Capsid |
| CUST_P10009806 | 5423 | 5480 | 2250 | Human papillomavirus type 6b (HPV 11) | L2 | Capsid |
| CUST_P10009808 | 5491 | 5548 | 2251 | Human papillomavirus type 6b (HPV 11) | L2 | Capsid |
| CUST_P10009809 | 5514 | 5566 | 2252 | Human papillomavirus type 6b (HPV 11) | L2 | Capsid |
| CUST_P10009810 | 5539 | 5586 | 2253 | Human papillomavirus type 6b (HPV 11) | L2 | Capsid |
| CUST_P10009811 | 5576 | 5622 | 2254 | Human papillomavirus type 6b (HPV 11) | L2 | Capsid |
| CUST_P10009812 | 5603 | 5651 | 2255 | Human papillomavirus type 6b (HPV 11) | L2 | Capsid |
| CUST_P10009813 | 5618 | 5670 | 2256 | Human papillomavirus type 6b (HPV 11) | L2 | Capsid |

TABLE 8-continued

Exemplary DNA virus probes

| ProbeID | Start | End | SEQ ID NO: | Virus | Genomic Region | Product |
|---|---|---|---|---|---|---|
| CUST_P10009814 | 5745 | 5800 | 2257 | Human papillomavirus type 6b (HPV 11) | L2 | Capsid |
| CUST_P10009815 | 5819 | 5875 | 2258 | Human papillomavirus type 6b (HPV 11) | L1 | PolyA |
| CUST_P10009816 | 5978 | 6034 | 2259 | Human papillomavirus type 6b (HPV 11) | L1 | PolyA |
| CUST_P10009817 | 6008 | 6059 | 2260 | Human papillomavirus type 6b (HPV 11) | L1 | PolyA |
| CUST_P10009818 | 6031 | 6075 | 2261 | Human papillomavirus type 6b (HPV 11) | L1 | PolyA |
| CUST_P10009819 | 6069 | 6113 | 2262 | Human papillomavirus type 6b (HPV 11) | L1 | PolyA |
| CUST_P10009820 | 6089 | 6139 | 2263 | Human papillomavirus type 6b (HPV 11) | L1 | PolyA |
| CUST_P10009821 | 6118 | 6177 | 2264 | Human papillomavirus type 6b (HPV 11) | L1 | PolyA |
| CUST_P10009822 | 6338 | 6390 | 2265 | Human papillomavirus type 6b (HPV 11) | L1 | PolyA |
| CUST_P10009823 | 6356 | 6415 | 2266 | Human papillomavirus type 6b (HPV 11) | L1 | PolyA |
| CUST_P10009824 | 6383 | 6442 | 2267 | Human papillomavirus type 6b (HPV 11) | L1 | PolyA |
| CUST_P10009825 | 6408 | 6467 | 2268 | Human papillomavirus type 6b (HPV 11) | L1 | PolyA |
| CUST_P10009826 | 6707 | 6757 | 2269 | Human papillomavirus type 6b (HPV 11) | L1 | PolyA |
| CUST_P10009827 | 6796 | 6855 | 2270 | Human papillomavirus type 6b (HPV 11) | L1 | PolyA |
| CUST_P10009828 | 7130 | 7187 | 2271 | Human papillomavirus type 6b (HPV 11) | L1 | PolyA |
| CUST_P10009831 | 13 | 69 | 2272 | Human papillomavirus type 6b (HPV 16) | E6 | Regulatory Protein |
| CUST_P10009832 | 54 | 113 | 2273 | Human papillomavirus type 6b (HPV 16) | E6 | Regulatory Protein |
| CUST_P10009833 | 221 | 280 | 2274 | Human papillomavirus type 6b (HPV 16) | E6 | Regulatory Protein |
| CUST_P10009834 | 355 | 414 | 2275 | Human papillomavirus type 6b (HPV 16) | E6 | Regulatory Protein |
| CUST_P10009836 | 564 | 623 | 2276 | Human papillomavirus type 6b (HPV 16) | E6 | Regulatory Protein |
| CUST_P10009837 | 704 | 758 | 2277 | Human papillomavirus type 6b (HPV 16) | E7 | Regulatory Protein |
| CUST_P10009838 | 816 | 867 | 2278 | Human papillomavirus type 6b (HPV 16) | E7 | Regulatory Protein |
| CUST_P10009839 | 969 | 1028 | 2279 | Human papillomavirus type 6b (HPV 16) | E1 | Regulatory Protein |
| CUST_P10009840 | 994 | 1053 | 2280 | Human papillomavirus type 6b (HPV 16) | E1 | Regulatory Protein |
| CUST_P10009841 | 1049 | 1098 | 2281 | Human papillomavirus type 6b (HPV 16) | E1 | Regulatory Protein |
| CUST_P10009842 | 1131 | 1190 | 2282 | Human papillomavirus type 6b (HPV 16) | E1 | Regulatory Protein |
| CUST_P10009843 | 1269 | 1316 | 2283 | Human papillomavirus type 6b (HPV 16) | E1 | Regulatory Protein |
| CUST_P10009844 | 1296 | 1346 | 2284 | Human papillomavirus type 6b (HPV 16) | E1 | Regulatory Protein |
| CUST_P10009845 | 1461 | 1520 | 2285 | Human papillomavirus type 6b (HPV 16) | E1 | Regulatory Protein |
| CUST_P10009846 | 1734 | 1793 | 2286 | Human papillomavirus type 6b (HPV 16) | E1 | Regulatory Protein |
| CUST_P10009847 | 1841 | 1900 | 2287 | Human papillomavirus type 6b (HPV 16) | E1 | Regulatory Protein |
| CUST_P10009848 | 2010 | 2069 | 2288 | Human papillomavirus type 6b (HPV 16) | E1 | Regulatory Protein |
| CUST_P10009849 | 2153 | 2212 | 2289 | Human papillomavirus type 6b (HPV 16) | E1 | Regulatory Protein |
| CUST_P10009850 | 2326 | 2385 | 2290 | Human papillomavirus type 6b (HPV 16) | E1 | Regulatory Protein |
| CUST_P10009851 | 2372 | 2431 | 2291 | Human papillomavirus type 6b (HPV 16) | E1 | Regulatory Protein |
| CUST_P10009852 | 2583 | 2642 | 2292 | Human papillomavirus type 6b (HPV 16) | E1 | Regulatory Protein |
| CUST_P10009853 | 2679 | 2732 | 2293 | Human papillomavirus type 6b (HPV 16) | E1 | Regulatory Protein |

TABLE 8-continued

Exemplary DNA virus probes

| ProbeID | Start | End | SEQ ID NO: | Virus | Genomic Region | Product |
| --- | --- | --- | --- | --- | --- | --- |
| CUST_P10009854 | 2745 | 2803 | 2294 | Human papillomavirus type 6b (HPV 16) | E1 | Regulatory Protein |
| CUST_P10009855 | 2862 | 2921 | 2295 | Human papillomavirus type 6b (HPV 16) | E2 | Regulatory Protein |
| CUST_P10009856 | 2895 | 2951 | 2296 | Human papillomavirus type 6b (HPV 16) | E2 | Regulatory Protein |
| CUST_P10009857 | 2932 | 2991 | 2297 | Human papillomavirus type 6b (HPV 16) | E2 | Regulatory Protein |
| CUST_P10009858 | 2974 | 3033 | 2298 | Human papillomavirus type 6b (HPV 16) | E2 | Regulatory Protein |
| CUST_P10009859 | 2995 | 3054 | 2299 | Human papillomavirus type 6b (HPV 16) | E2 | Regulatory Protein |
| CUST_P10009860 | 3091 | 3150 | 2300 | Human papillomavirus type 6b (HPV 16) | E2 | Regulatory Protein |
| CUST_P10009861 | 3190 | 3249 | 2301 | Human papillomavirus type 6b (HPV 16) | E2 | Regulatory Protein |
| CUST_P10009862 | 3325 | 3384 | 2302 | Human papillomavirus type 6b (HPV 16) | E2 | Regulatory Protein |
| CUST_P10009864 | 3437 | 3481 | 2303 | Human papillomavirus type 6b (HPV 16) | E2 | Regulatory Protein |
| CUST_P10009867 | 3503 | 3547 | 2304 | Human papillomavirus type 6b (HPV 16) | E2 | Regulatory Protein |
| CUST_P10009868 | 3777 | 3836 | 2305 | Human papillomavirus type 6b (HPV 16) | E2 | Regulatory Protein |
| CUST_P10009869 | 3949 | 4008 | 2306 | Human papillomavirus type 6b (HPV 16) | E5 | Regulatory Protein |
| CUST_P10009870 | 4245 | 4297 | 2307 | Human papillomavirus type 6b (HPV 16) | E5 | Regulatory Protein |
| CUST_P10009871 | 4323 | 4382 | 2308 | Human papillomavirus type 6b (HPV 16) | L2 | Capsid |
| CUST_P10009872 | 4347 | 4406 | 2309 | Human papillomavirus type 6b (HPV 16) | L2 | Capsid |
| CUST_P10009873 | 4510 | 4566 | 2310 | Human papillomavirus type 6b (HPV 16) | L2 | Capsid |
| CUST_P10009874 | 4532 | 4591 | 2311 | Human papillomavirus type 6b (HPV 16) | L2 | Capsid |
| CUST_P10009875 | 4644 | 4703 | 2312 | Human papillomavirus type 6b (HPV 16) | L2 | Capsid |
| CUST_P10009876 | 4680 | 4739 | 2313 | Human papillomavirus type 6b (HPV 16) | L2 | Capsid |
| CUST_P10009878 | 4821 | 4880 | 2314 | Human papillomavirus type 6b (HPV 16) | L2 | Capsid |
| CUST_P10009879 | 4842 | 4890 | 2315 | Human papillomavirus type 6b (HPV 16) | L2 | Capsid |
| CUST_P10009880 | 4898 | 4951 | 2316 | Human papillomavirus type 6b (HPV 16) | L2 | Capsid |
| CUST_P10009881 | 4931 | 4990 | 2317 | Human papillomavirus type 6b (HPV 16) | L2 | Capsid |
| CUST_P10009882 | 5068 | 5125 | 2318 | Human papillomavirus type 6b (HPV 16) | L2 | Capsid |
| CUST_P10009883 | 5237 | 5296 | 2319 | Human papillomavirus type 6b (HPV 16) | L2 | Capsid |
| CUST_P10009884 | 5292 | 5351 | 2320 | Human papillomavirus type 6b (HPV 16) | L2 | Capsid |
| CUST_P10009885 | 5444 | 5503 | 2321 | Human papillomavirus type 6b (HPV 16) | L2 | Capsid |
| CUST_P10009886 | 5527 | 5586 | 2322 | Human papillomavirus type 6b (HPV 16) | L2 | Capsid |
| CUST_P10009887 | 5685 | 5744 | 2323 | Human papillomavirus type 6b (HPV 16) | L2 | Capsid |
| CUST_P10009888 | 5849 | 5908 | 2324 | Human papillomavirus type 6b (HPV 16) | L1 | PolyA |
| CUST_P10009891 | 6051 | 6110 | 2325 | Human papillomavirus type 6b (HPV 16) | L1 | PolyA |
| CUST_P10009892 | 6078 | 6137 | 2326 | Human papillomavirus type 6b (HPV 16) | L1 | PolyA |
| CUST_P10009893 | 6192 | 6251 | 2327 | Human papillomavirus type 6b (HPV 16) | L1 | PolyA |
| CUST_P10009894 | 6527 | 6586 | 2328 | Human papillomavirus type 6b (HPV 16) | L1 | PolyA |
| CUST_P10009895 | 6551 | 6610 | 2329 | Human papillomavirus type 6b (HPV 16) | L1 | PolyA |
| CUST_P10009896 | 6735 | 6794 | 2330 | Human papillomavirus type 6b (HPV 16) | L1 | PolyA |

TABLE 8-continued

Exemplary DNA virus probes

| ProbeID | Start | End | SEQ ID NO: | Virus | Genomic Region | Product |
|---|---|---|---|---|---|---|
| CUST_P10009897 | 6786 | 6845 | 2331 | Human papillomavirus type 6b (HPV 16) | L1 | PolyA |
| CUST_P10009898 | 6868 | 6923 | 2332 | Human papillomavirus type 6b (HPV 16) | L1 | PolyA |
| CUST_P10009899 | 7030 | 7089 | 2333 | Human papillomavirus type 6b (HPV 16) | L1 | PolyA |
| CUST_P10009900 | 7329 | 7388 | 2334 | Human papillomavirus type 6b (HPV 16) | L1 | PolyA |
| CUST_P10009901 | 7571 | 7620 | 2335 | Human papillomavirus type 6b (HPV 16) | L1 | PolyA |
| CUST_P10009902 | 7677 | 7736 | 2336 | Human papillomavirus type 6b (HPV 16) | L1 | PolyA |
| CUST_P10009903 | 7700 | 7759 | 2337 | Human papillomavirus type 6b (HPV 16) | L1 | PolyA |
| CUST_P10009904 | 7723 | 7782 | 2338 | Human papillomavirus type 6b (HPV 16) | L1 | PolyA |
| CUST_P10009905 | 7756 | 7815 | 2339 | Human papillomavirus type 6b (HPV 16) | L1 | PolyA |
| CUST_P10009906 | 7789 | 7848 | 2340 | Human papillomavirus type 6b (HPV 16) | L1 | PolyA |
| CUST_P10009907 | 7824 | 7880 | 2341 | Human papillomavirus type 6b (HPV 16) | L1 | PolyA |
| CUST_P10009908 | 7846 | 7905 | 2342 | Human papillomavirus type 6b (HPV 16) | L1 | PolyA |
| CUST_P10009909 | 6 | 65 | 2343 | Human papillomavirus type 6b (HPV 18) | E6 | Regulatory Protein |
| CUST_P10009910 | 60 | 116 | 2344 | Human papillomavirus type 6b (HPV 18) | E6 | Regulatory Protein |
| CUST_P10009911 | 182 | 241 | 2345 | Human papillomavirus type 6b (HPV 18) | E6 | Regulatory Protein |
| CUST_P10009912 | 233 | 292 | 2346 | Human papillomavirus type 6b (HPV 18) | E6 | Regulatory Protein |
| CUST_P10009913 | 254 | 313 | 2347 | Human papillomavirus type 6b (HPV 18) | E6 | Regulatory Protein |
| CUST_P10009914 | 291 | 350 | 2348 | Human papillomavirus type 6b (HPV 18) | E6 | Regulatory Protein |
| CUST_P10009915 | 339 | 398 | 2349 | Human papillomavirus type 6b (HPV 18) | E6 | Regulatory Protein |
| CUST_P10009916 | 369 | 428 | 2350 | Human papillomavirus type 6b (HPV 18) | E6 | Regulatory Protein |
| CUST_P10009917 | 422 | 468 | 2351 | Human papillomavirus type 6b (HPV 18) | E6 | Regulatory Protein |
| CUST_P10009918 | 535 | 583 | 2352 | Human papillomavirus type 6b (HPV 18) | E6 | Regulatory Protein |
| CUST_P10009919 | 560 | 619 | 2353 | Human papillomavirus type 6b (HPV 18) | E6 | Regulatory Protein |
| CUST_P10009920 | 594 | 651 | 2354 | Human papillomavirus type 6b (HPV 18) | E7 | Regulatory Protein |
| CUST_P10009921 | 643 | 694 | 2355 | Human papillomavirus type 6b (HPV 18) | E7 | Regulatory Protein |
| CUST_P10009922 | 681 | 740 | 2356 | Human papillomavirus type 6b (HPV 18) | E7 | Regulatory Protein |
| CUST_P10009925 | 1017 | 1071 | 2357 | Human papillomavirus type 6b (HPV 18) | E1 | Regulatory Protein |
| CUST_P10009926 | 1134 | 1187 | 2358 | Human papillomavirus type 6b (HPV 18) | E1 | Regulatory Protein |
| CUST_P10009927 | 1302 | 1357 | 2359 | Human papillomavirus type 6b (HPV 18) | E1 | Regulatory Protein |
| CUST_P10009928 | 1663 | 1722 | 2360 | Human papillomavirus type 6b (HPV 18) | E1 | Regulatory Protein |
| CUST_P10009929 | 1691 | 1750 | 2361 | Human papillomavirus type 6b (HPV 18) | E1 | Regulatory Protein |
| CUST_P10009930 | 1719 | 1778 | 2362 | Human papillomavirus type 6b (HPV 18) | E1 | Regulatory Protein |
| CUST_P10009931 | 1883 | 1942 | 2363 | Human papillomavirus type 6b (HPV 18) | E1 | Regulatory Protein |
| CUST_P10009932 | 1937 | 1996 | 2364 | Human papillomavirus type 6b (HPV 18) | E1 | Regulatory Protein |
| CUST_P10009933 | 2186 | 2245 | 2365 | Human papillomavirus type 6b (HPV 18) | E1 | Regulatory Protein |
| CUST_P10009934 | 2210 | 2269 | 2366 | Human papillomavirus type 6b (HPV 18) | E1 | Regulatory Protein |
| CUST_P10009935 | 2392 | 2451 | 2367 | Human papillomavirus type 6b (HPV 18) | E1 | Regulatory Protein |

TABLE 8-continued

Exemplary DNA virus probes

| ProbeID | Start | End | SEQ ID NO: | Virus | Genomic Region | Product |
|---|---|---|---|---|---|---|
| CUST_P10009936 | 2430 | 2489 | 2368 | Human papillomavirus type 6b (HPV 18) | E1 | Regulatory Protein |
| CUST_P10009937 | 2471 | 2520 | 2369 | Human papillomavirus type 6b (HPV 18) | E1 | Regulatory Protein |
| CUST_P10009938 | 2512 | 2571 | 2370 | Human papillomavirus type 6b (HPV 18) | E1 | Regulatory Protein |
| CUST_P10009939 | 2558 | 2617 | 2371 | Human papillomavirus type 6b (HPV 18) | E1 | Regulatory Protein |
| CUST_P10009940 | 2606 | 2665 | 2372 | Human papillomavirus type 6b (HPV 18) | E1 | Regulatory Protein |
| CUST_P10009941 | 2642 | 2701 | 2373 | Human papillomavirus type 6b (HPV 18) | E1 | Regulatory Protein |
| CUST_P10009942 | 2808 | 2852 | 2374 | Human papillomavirus type 6b (HPV 18) | E1 | Regulatory Protein |
| CUST_P10009943 | 2837 | 2891 | 2375 | Human papillomavirus type 6b (HPV 18) | E2 | Regulatory Protein |
| CUST_P10009944 | 2858 | 2917 | 2376 | Human papillomavirus type 6b (HPV 18) | E2 | Regulatory Protein |
| CUST_P10009945 | 2885 | 2944 | 2377 | Human papillomavirus type 6b (HPV 18) | E2 | Regulatory Protein |
| CUST_P10009946 | 2914 | 2973 | 2378 | Human papillomavirus type 6b (HPV 18) | E2 | Regulatory Protein |
| CUST_P10009947 | 3085 | 3133 | 2379 | Human papillomavirus type 6b (HPV 18) | E2 | Regulatory Protein |
| CUST_P10009948 | 3205 | 3264 | 2380 | Human papillomavirus type 6b (HPV 18) | E2 | Regulatory Protein |
| CUST_P10009949 | 3260 | 3312 | 2381 | Human papillomavirus type 6b (HPV 18) | E2 | Regulatory Protein |
| CUST_P10009952 | 3727 | 3781 | 2382 | Human papillomavirus type 6b (HPV 18) | E2 | Regulatory Protein |
| CUST_P10009953 | 3753 | 3807 | 2383 | Human papillomavirus type 6b (HPV 18) | E4 | Regulatory Protein |
| CUST_P10009954 | 4025 | 4080 | 2384 | Human papillomavirus type 6b (HPV 18) | E5 | Regulatory Protein |
| CUST_P10009955 | 4262 | 4316 | 2385 | Human papillomavirus type 6b (HPV 18) | L2 | Capsid |
| CUST_P10009956 | 4357 | 4414 | 2386 | Human papillomavirus type 6b (HPV 18) | L2 | Capsid |
| CUST_P10009959 | 4544 | 4599 | 2387 | Human papillomavirus type 6b (HPV 18) | L2 | Capsid |
| CUST_P10009960 | 4678 | 4735 | 2388 | Human papillomavirus type 6b (HPV 18) | L2 | Capsid |
| CUST_P10009961 | 4704 | 4762 | 2389 | Human papillomavirus type 6b (HPV 18) | L2 | Capsid |
| CUST_P10009962 | 4796 | 4852 | 2390 | Human papillomavirus type 6b (HPV 18) | L2 | Capsid |
| CUST_P10009964 | 4933 | 4979 | 2391 | Human papillomavirus type 6b (HPV 18) | L2 | Capsid |
| CUST_P10009965 | 4947 | 5002 | 2392 | Human papillomavirus type 6b (HPV 18) | L2 | Capsid |
| CUST_P10009967 | 5016 | 5075 | 2393 | Human papillomavirus type 6b (HPV 18) | L2 | Capsid |
| CUST_P10009968 | 5037 | 5096 | 2394 | Human papillomavirus type 6b (HPV 18) | L2 | Capsid |
| CUST_P10009969 | 5067 | 5119 | 2395 | Human papillomavirus type 6b (HPV 18) | L2 | Capsid |
| CUST_P10009970 | 5218 | 5269 | 2396 | Human papillomavirus type 6b (HPV 18) | L2 | Capsid |
| CUST_P10009971 | 5412 | 5462 | 2397 | Human papillomavirus type 6b (HPV 18) | L2 | Capsid |
| CUST_P10009972 | 5437 | 5495 | 2398 | Human papillomavirus type 6b (HPV 18) | L2 | Capsid |
| CUST_P10009973 | 5635 | 5693 | 2399 | Human papillomavirus type 6b (HPV 18) | L2 | Capsid |
| CUST_P10009975 | 5781 | 5840 | 2400 | Human papillomavirus type 6b (HPV 18) | L1 | PolyA |
| CUST_P10009976 | 5823 | 5882 | 2401 | Human papillomavirus type 6b (HPV 18) | L1 | PolyA |
| CUST_P10009977 | 5844 | 5903 | 2402 | Human papillomavirus type 6b (HPV 18) | L1 | PolyA |
| CUST_P10009978 | 5873 | 5927 | 2403 | Human papillomavirus type 6b (HPV 18) | L1 | PolyA |
| CUST_P10009979 | 6014 | 6068 | 2404 | Human papillomavirus type 6b (HPV 18) | L1 | PolyA |

TABLE 8-continued

Exemplary DNA virus probes

| ProbeID | Start | End | SEQ ID NO: | Virus | Genomic Region | Product |
|---|---|---|---|---|---|---|
| CUST_P10009980 | 6030 | 6089 | 2405 | Human papillomavirus type 6b (HPV 18) | L1 | PolyA |
| CUST_P10009981 | 6111 | 6158 | 2406 | Human papillomavirus type 6b (HPV 18) | L1 | PolyA |
| CUST_P10009982 | 6122 | 6167 | 2407 | Human papillomavirus type 6b (HPV 18) | L1 | PolyA |
| CUST_P10009983 | 6149 | 6200 | 2408 | Human papillomavirus type 6b (HPV 18) | L1 | PolyA |
| CUST_P10009984 | 6175 | 6234 | 2409 | Human papillomavirus type 6b (HPV 18) | L1 | PolyA |
| CUST_P10009985 | 6284 | 6343 | 2410 | Human papillomavirus type 6b (HPV 18) | L1 | PolyA |
| CUST_P10009986 | 6409 | 6462 | 2411 | Human papillomavirus type 6b (HPV 18) | L1 | PolyA |
| CUST_P10009987 | 6516 | 6575 | 2412 | Human papillomavirus type 6b (HPV 18) | L1 | PolyA |
| CUST_P10009988 | 6547 | 6606 | 2413 | Human papillomavirus type 6b (HPV 18) | L1 | PolyA |
| CUST_P10009989 | 6669 | 6728 | 2414 | Human papillomavirus type 6b (HPV 18) | L1 | PolyA |
| CUST_P10009990 | 6765 | 6824 | 2415 | Human papillomavirus type 6b (HPV 18) | L1 | PolyA |
| CUST_P10009991 | 6890 | 6947 | 2416 | Human papillomavirus type 6b (HPV 18) | L1 | PolyA |
| CUST_P10009992 | 6911 | 6970 | 2417 | Human papillomavirus type 6b (HPV 18) | L1 | PolyA |
| CUST_P10009993 | 6954 | 7013 | 2418 | Human papillomavirus type 6b (HPV 18) | L1 | PolyA |
| CUST_P10009994 | 6997 | 7042 | 2419 | Human papillomavirus type 6b (HPV 18) | L1 | PolyA |
| CUST_P10010004 | 44 | 88 | 2420 | Hepatitis B virus subtype adw | S | surface protein |
| CUST_P10010005 | 78 | 126 | 2421 | Hepatitis B virus subtype adw | S | surface protein |
| CUST_P10010006 | 158 | 202 | 2422 | Hepatitis B virus subtype adw | S | surface protein |
| CUST_P10010008 | 230 | 281 | 2423 | Hepatitis B virus subtype adw | S | surface protein |
| CUST_P10010009 | 267 | 311 | 2424 | Hepatitis B virus subtype adw | S | surface protein |
| CUST_P10010010 | 328 | 372 | 2425 | Hepatitis B virus subtype adw | S | surface protein |
| CUST_P10010011 | 394 | 453 | 2426 | Hepatitis B virus subtype adw | S | surface protein |
| CUST_P10010012 | 419 | 475 | 2427 | Hepatitis B virus subtype adw | S | surface protein |
| CUST_P10010013 | 441 | 494 | 2428 | Hepatitis B virus subtype adw | S | surface protein |
| CUST_P10010015 | 600 | 647 | 2429 | Hepatitis B virus subtype adw | S | surface protein |
| CUST_P10010016 | 624 | 668 | 2430 | Hepatitis B virus subtype adw | S | surface protein |
| CUST_P10010017 | 840 | 899 | 2431 | Hepatitis B virus subtype adw | S | surface protein |
| CUST_P10010018 | 981 | 1036 | 2432 | Hepatitis B virus subtype adw | C | Core |
| CUST_P10010019 | 1040 | 1099 | 2433 | Hepatitis B virus subtype adw | C | Core |
| CUST_P10010020 | 1085 | 1144 | 2434 | Hepatitis B virus subtype adw | C | Core |
| CUST_P10010021 | 1130 | 1174 | 2435 | Hepatitis B virus subtype adw | C | Core |
| CUST_P10010022 | 1170 | 1214 | 2436 | Hepatitis B virus subtype adw | C | Core |
| CUST_P10010023 | 1216 | 1260 | 2437 | Hepatitis B virus subtype adw | C | Core |
| CUST_P10010024 | 1241 | 1285 | 2438 | Hepatitis B virus subtype adw | C | Core |
| CUST_P10010025 | 1282 | 1326 | 2439 | Hepatitis B virus subtype adw | C | Core |
| CUST_P10010026 | 1453 | 1497 | 2440 | Hepatitis B virus subtype adw | C | Core |
| CUST_P10010027 | 1560 | 1605 | 2441 | Hepatitis B virus subtype adw | C | Core |
| CUST_P10010028 | 1581 | 1625 | 2442 | Hepatitis B virus subtype adw | C | Core |
| CUST_P10010029 | 1623 | 1667 | 2443 | Hepatitis B virus subtype adw | C | Core |
| CUST_P10010030 | 1643 | 1691 | 2444 | Hepatitis B virus subtype adw | C | Core |
| CUST_P10010031 | 1679 | 1728 | 2445 | Hepatitis B virus subtype adw | C | Core |
| CUST_P10010032 | 1696 | 1743 | 2446 | Hepatitis B virus subtype adw | C | Core |
| CUST_P10010033 | 1743 | 1796 | 2447 | Hepatitis B virus subtype adw | C | Core |
| CUST_P10010034 | 1948 | 1998 | 2448 | Hepatitis B virus subtype adw | C | Core |
| CUST_P10010035 | 2054 | 2099 | 2449 | Hepatitis B virus subtype adw | C | Core |
| CUST_P10010036 | 2131 | 2190 | 2450 | Hepatitis B virus subtype adw | C | Core |
| CUST_P10010037 | 2164 | 2223 | 2451 | Hepatitis B virus subtype adw | C | Core |
| CUST_P10010038 | 2208 | 2267 | 2452 | Hepatitis B virus subtype adw | C | Core |
| CUST_P10010039 | 2238 | 2285 | 2453 | Hepatitis B virus subtype adw | C | Core |
| CUST_P10010040 | 2275 | 2321 | 2454 | Hepatitis B virus subtype adw | C | Core |
| CUST_P10010041 | 2293 | 2349 | 2455 | Hepatitis B virus subtype adw | C | Core |
| CUST_P10010042 | 2334 | 2378 | 2456 | Hepatitis B virus subtype adw | C | Core |
| CUST_P10010044 | 2416 | 2463 | 2457 | Hepatitis B virus subtype adw | C | Core |
| CUST_P10010045 | 2431 | 2490 | 2458 | Hepatitis B virus subtype adw | C | Core |
| CUST_P10010046 | 2469 | 2528 | 2459 | Hepatitis B virus subtype adw | C | Core |
| CUST_P10010047 | 2510 | 2569 | 2460 | Hepatitis B virus subtype adw | C | Core |
| CUST_P10010048 | 2539 | 2598 | 2461 | Hepatitis B virus subtype adw | C | Core |
| CUST_P10010049 | 2666 | 2725 | 2462 | Hepatitis B virus subtype adw | C | Core |
| CUST_P10010050 | 2690 | 2749 | 2463 | Hepatitis B virus subtype adw | C | Core |
| CUST_P10010051 | 2723 | 2782 | 2464 | Hepatitis B virus subtype adw | C | Core |

TABLE 8-continued

Exemplary DNA virus probes

| ProbeID | Start | End | SEQ ID NO: | Virus | Genomic Region | Product |
|---|---|---|---|---|---|---|
| CUST_P10010052 | 2868 | 2912 | 2465 | Hepatitis B virus subtype adw | C | Core |
| CUST_P10010053 | 2933 | 2980 | 2466 | Hepatitis B virus subtype adw | P | Pol |
| CUST_P10010054 | 2961 | 3007 | 2467 | Hepatitis B virus subtype adw | P | Pol |
| CUST_P10010055 | 2976 | 3020 | 2468 | Hepatitis B virus subtype adw | P | Pol |
| CUST_P10010056 | 3014 | 3058 | 2469 | Hepatitis B virus subtype adw | P | Pol |
| CUST_P10010058 | 3163 | 3207 | 2470 | Hepatitis B virus subtype adw | P | Pol |
| CUST_P10010059 | 1 | 46 | 2471 | Hepatitis B virus subtype ayw | S | surface protein |
| CUST_P10010060 | 74 | 118 | 2472 | Hepatitis B virus subtype ayw | S | surface protein |
| CUST_P10010061 | 93 | 138 | 2473 | Hepatitis B virus subtype ayw | S | surface protein |
| CUST_P10010062 | 114 | 158 | 2474 | Hepatitis B virus subtype ayw | S | surface protein |
| CUST_P10010063 | 155 | 201 | 2475 | Hepatitis B virus subtype ayw | S | surface protein |
| CUST_P10010064 | 190 | 240 | 2476 | Hepatitis B virus subtype ayw | S | surface protein |
| CUST_P10010065 | 234 | 283 | 2477 | Hepatitis B virus subtype ayw | S | surface protein |
| CUST_P10010066 | 264 | 313 | 2478 | Hepatitis B virus subtype ayw | S | surface protein |
| CUST_P10010067 | 295 | 339 | 2479 | Hepatitis B virus subtype ayw | S | surface protein |
| CUST_P10010068 | 330 | 374 | 2480 | Hepatitis B virus subtype ayw | S | surface protein |
| CUST_P10010069 | 369 | 416 | 2481 | Hepatitis B virus subtype ayw | S | surface protein |
| CUST_P10010070 | 392 | 447 | 2482 | Hepatitis B virus subtype ayw | S | surface protein |
| CUST_P10010071 | 443 | 493 | 2483 | Hepatitis B virus subtype ayw | S | surface protein |
| CUST_P10010072 | 473 | 517 | 2484 | Hepatitis B virus subtype ayw | S | surface protein |
| CUST_P10010073 | 600 | 645 | 2485 | Hepatitis B virus subtype ayw | S | surface protein |
| CUST_P10010076 | 851 | 907 | 2486 | Hepatitis B virus subtype ayw | X | x-protein |
| CUST_P10010077 | 983 | 1033 | 2487 | Hepatitis B virus subtype ayw | X | x-protein |
| CUST_P10010078 | 1028 | 1087 | 2488 | Hepatitis B virus subtype ayw | X | x-protein |
| CUST_P10010079 | 1091 | 1147 | 2489 | Hepatitis B virus subtype ayw | X | x-protein |
| CUST_P10010080 | 1161 | 1205 | 2490 | Hepatitis B virus subtype ayw | X | x-protein |
| CUST_P10010081 | 1218 | 1262 | 2491 | Hepatitis B virus subtype ayw | X | x-protein |
| CUST_P10010082 | 1265 | 1309 | 2492 | Hepatitis B virus subtype ayw | X | x-protein |
| CUST_P10010083 | 1319 | 1374 | 2493 | Hepatitis B virus subtype ayw | X | x-protein |
| CUST_P10010084 | 1384 | 1429 | 2494 | Hepatitis B virus subtype ayw | X | x-protein |
| CUST_P10010085 | 1446 | 1490 | 2495 | Hepatitis B virus subtype ayw | X | x-protein |
| CUST_P10010086 | 1476 | 1520 | 2496 | Hepatitis B virus subtype ayw | X | x-protein |
| CUST_P10010087 | 1528 | 1572 | 2497 | Hepatitis B virus subtype ayw | X | x-protein |
| CUST_P10010088 | 1552 | 1596 | 2498 | Hepatitis B virus subtype ayw | X | x-protein |
| CUST_P10010089 | 1610 | 1654 | 2499 | Hepatitis B virus subtype ayw | X | x-protein |
| CUST_P10010090 | 1636 | 1685 | 2500 | Hepatitis B virus subtype ayw | X | x-protein |
| CUST_P10010092 | 1815 | 1870 | 2501 | Hepatitis B virus subtype ayw | C | Core |
| CUST_P10010093 | 2042 | 2088 | 2502 | Hepatitis B virus subtype ayw | C | Core |
| CUST_P10010094 | 2133 | 2192 | 2503 | Hepatitis B virus subtype ayw | C | Core |
| CUST_P10010095 | 2162 | 2221 | 2504 | Hepatitis B virus subtype ayw | C | Core |
| CUST_P10010096 | 2210 | 2269 | 2505 | Hepatitis B virus subtype ayw | C | Core |
| CUST_P10010097 | 2343 | 2387 | 2506 | Hepatitis B virus subtype ayw | C | Core |
| CUST_P10010098 | 2390 | 2434 | 2507 | Hepatitis B virus subtype ayw | C | Core |
| CUST_P10010099 | 2427 | 2477 | 2508 | Hepatitis B virus subtype ayw | C | Core |
| CUST_P10010100 | 2535 | 2594 | 2509 | Hepatitis B virus subtype ayw | C | Core |
| CUST_P10010101 | 2577 | 2636 | 2510 | Hepatitis B virus subtype ayw | P | Pol |
| CUST_P10010102 | 2641 | 2700 | 2511 | Hepatitis B virus subtype ayw | P | Pol |
| CUST_P10010103 | 2698 | 2757 | 2512 | Hepatitis B virus subtype ayw | P | Pol |
| CUST_P10010104 | 2756 | 2815 | 2513 | Hepatitis B virus subtype ayw | P | Pol |
| CUST_P10010105 | 2794 | 2845 | 2514 | Hepatitis B virus subtype ayw | P | Pol |
| CUST_P10010106 | 2824 | 2872 | 2515 | Hepatitis B virus subtype ayw | P | Pol |
| CUST_P10010107 | 2856 | 2900 | 2516 | Hepatitis B virus subtype ayw | P | Pol |
| CUST_P10010108 | 2885 | 2929 | 2517 | Hepatitis B virus subtype ayw | P | Pol |
| CUST_P10010109 | 2915 | 2963 | 2518 | Hepatitis B virus subtype ayw | P | Pol |
| CUST_P10010110 | 3046 | 3090 | 2519 | Hepatitis B virus subtype ayw | P | Pol |
| CUST_P10010111 | 3121 | 3165 | 2520 | Hepatitis B virus subtype ayw | P | Pol |
| CUST_P10010112 | 8 | 55 | 2521 | Hepatitis B virus, subtype adr | P | Pol |
| CUST_P10010113 | 79 | 125 | 2522 | Hepatitis B virus, subtype adr | P | Pol |
| CUST_P10010114 | 112 | 156 | 2523 | Hepatitis B virus, subtype adr | P | Pol |
| CUST_P10010119 | 325 | 370 | 2524 | Hepatitis B virus, subtype adr | P | Pol |
| CUST_P10010122 | 451 | 497 | 2525 | Hepatitis B virus, subtype adr | P | Pol |
| CUST_P10010123 | 477 | 521 | 2526 | Hepatitis B virus, subtype adr | P | Pol |
| CUST_P10010124 | 638 | 682 | 2527 | Hepatitis B virus, subtype adr | P | Pol |
| CUST_P10010125 | 667 | 714 | 2528 | Hepatitis B virus, subtype adr | P | Pol |
| CUST_P10010126 | 705 | 754 | 2529 | Hepatitis B virus, subtype adr | P | Pol |
| CUST_P10010127 | 839 | 894 | 2530 | Hepatitis B virus, subtype adr | P | Pol |
| CUST_P10010128 | 971 | 1022 | 2531 | Hepatitis B virus, subtype adr | P | Pol |
| CUST_P10010129 | 1088 | 1145 | 2532 | Hepatitis B virus, subtype adr | P | Pol |
| CUST_P10010131 | 1160 | 1204 | 2533 | Hepatitis B virus, subtype adr | P | Pol |
| CUST_P10010132 | 1203 | 1247 | 2534 | Hepatitis B virus, subtype adr | P | Pol |
| CUST_P10010133 | 1315 | 1361 | 2535 | Hepatitis B virus, subtype adr | P | Pol |
| CUST_P10010134 | 1458 | 1502 | 2536 | Hepatitis B virus, subtype adr | P | Pol |
| CUST_P10010136 | 1556 | 1600 | 2537 | Hepatitis B virus, subtype adr | P | Pol |
| CUST_P10010137 | 1635 | 1683 | 2538 | Hepatitis B virus, subtype adr | P | Pol |
| CUST_P10010138 | 1679 | 1729 | 2539 | Hepatitis B virus, subtype adr | C | Core |

TABLE 8-continued

Exemplary DNA virus probes

| ProbeID | Start | End | SEQ ID NO: | Virus | Genomic Region | Product |
|---|---|---|---|---|---|---|
| CUST_P10010139 | 1810 | 1864 | 2540 | Hepatitis B virus, subtype adr | C | Core |
| CUST_P10010140 | 1999 | 2043 | 2541 | Hepatitis B virus, subtype adr | C | Core |
| CUST_P10010141 | 2109 | 2153 | 2542 | Hepatitis B virus, subtype adr | C | Core |
| CUST_P10010142 | 2220 | 2279 | 2543 | Hepatitis B virus, subtype adr | C | Core |
| CUST_P10010143 | 2247 | 2294 | 2544 | Hepatitis B virus, subtype adr | C | Core |
| CUST_P10010144 | 2295 | 2346 | 2545 | Hepatitis B virus, subtype adr | C | Core |
| CUST_P10010145 | 2365 | 2409 | 2546 | Hepatitis B virus, subtype adr | C | Core |
| CUST_P10010148 | 2545 | 2604 | 2547 | Hepatitis B virus, subtype adr | P | Pol |
| CUST_P10010149 | 2575 | 2634 | 2548 | Hepatitis B virus, subtype adr | P | Pol |
| CUST_P10010150 | 2618 | 2677 | 2549 | Hepatitis B virus, subtype adr | P | Pol |
| CUST_P10010151 | 2646 | 2705 | 2550 | Hepatitis B virus, subtype adr | P | Pol |
| CUST_P10010152 | 2672 | 2731 | 2551 | Hepatitis B virus, subtype adr | P | Pol |
| CUST_P10010153 | 2699 | 2758 | 2552 | Hepatitis B virus, subtype adr | P | Pol |
| CUST_P10010154 | 2735 | 2794 | 2553 | Hepatitis B virus, subtype adr | P | Pol |
| CUST_P10010156 | 2928 | 2972 | 2554 | Hepatitis B virus, subtype adr | S1 | surface protein |
| CUST_P10010157 | 2976 | 3020 | 2555 | Hepatitis B virus, subtype adr | S1 | surface protein |
| CUST_P10010158 | 3063 | 3107 | 2556 | Hepatitis B virus, subtype adr | S1 | surface protein |
| CUST_P10010159 | 42 | 86 | 2557 | Hepatitis B virus, subtype ayr | P | Pol |
| CUST_P10010160 | 79 | 126 | 2558 | Hepatitis B virus, subtype ayr | P | Pol |
| CUST_P10010161 | 133 | 177 | 2559 | Hepatitis B virus, subtype ayr | S | surface protein |
| CUST_P10010162 | 158 | 202 | 2560 | Hepatitis B virus, subtype ayr | S | surface protein |
| CUST_P10010163 | 190 | 238 | 2561 | Hepatitis B virus, subtype ayr | S | surface protein |
| CUST_P10010164 | 227 | 280 | 2562 | Hepatitis B virus, subtype ayr | S | surface protein |
| CUST_P10010165 | 272 | 316 | 2563 | Hepatitis B virus, subtype ayr | S | surface protein |
| CUST_P10010166 | 328 | 372 | 2564 | Hepatitis B virus, subtype ayr | S | surface protein |
| CUST_P10010167 | 366 | 414 | 2565 | Hepatitis B virus, subtype ayr | S | surface protein |
| CUST_P10010168 | 390 | 447 | 2566 | Hepatitis B virus, subtype ayr | S | surface protein |
| CUST_P10010169 | 452 | 500 | 2567 | Hepatitis B virus, subtype ayr | S | surface protein |
| CUST_P10010170 | 477 | 521 | 2568 | Hepatitis B virus, subtype ayr | S | surface protein |
| CUST_P10010171 | 598 | 642 | 2569 | Hepatitis B virus, subtype ayr | S | surface protein |
| CUST_P10010172 | 659 | 707 | 2570 | Hepatitis B virus, subtype ayr | S | surface protein |
| CUST_P10010173 | 839 | 898 | 2571 | Hepatitis B virus, subtype ayr | P | Pol |
| CUST_P10010174 | 971 | 1023 | 2572 | Hepatitis B virus, subtype ayr | P | Pol |
| CUST_P10010175 | 1087 | 1146 | 2573 | Hepatitis B virus, subtype ayr | P | Pol |
| CUST_P10010176 | 1116 | 1163 | 2574 | Hepatitis B virus, subtype ayr | P | Pol |
| CUST_P10010177 | 1151 | 1195 | 2575 | Hepatitis B virus, subtype ayr | P | Pol |
| CUST_P10010179 | 1318 | 1366 | 2576 | Hepatitis B virus, subtype ayr | P | Pol |
| CUST_P10010180 | 1356 | 1400 | 2577 | Hepatitis B virus, subtype ayr | X | x-protein |
| CUST_P10010181 | 1388 | 1432 | 2578 | Hepatitis B virus, subtype ayr | X | x-protein |
| CUST_P10010182 | 1419 | 1463 | 2579 | Hepatitis B virus, subtype ayr | X | x-protein |
| CUST_P10010183 | 1472 | 1516 | 2580 | Hepatitis B virus, subtype ayr | X | x-protein |
| CUST_P10010185 | 1565 | 1609 | 2581 | Hepatitis B virus, subtype ayr | X | x-protein |
| CUST_P10010187 | 1643 | 1690 | 2582 | Hepatitis B virus, subtype ayr | X | x-protein |
| CUST_P10010188 | 1675 | 1725 | 2583 | Hepatitis B virus, subtype ayr | X | x-protein |
| CUST_P10010189 | 1808 | 1856 | 2584 | Hepatitis B virus, subtype ayr | X | x-protein |
| CUST_P10010190 | 1941 | 1996 | 2585 | Hepatitis B virus, subtype ayr | C | Core |
| CUST_P10010191 | 2001 | 2045 | 2586 | Hepatitis B virus, subtype ayr | C | Core |
| CUST_P10010192 | 2111 | 2155 | 2587 | Hepatitis B virus, subtype ayr | C | Core |
| CUST_P10010193 | 2210 | 2266 | 2588 | Hepatitis B virus, subtype ayr | C | Core |
| CUST_P10010194 | 2290 | 2335 | 2589 | Hepatitis B virus, subtype ayr | C | Core |
| CUST_P10010195 | 2365 | 2409 | 2590 | Hepatitis B virus, subtype ayr | C | Core |
| CUST_P10010196 | 2410 | 2456 | 2591 | Hepatitis B virus, subtype ayr | C | Core |
| CUST_P10010197 | 2430 | 2484 | 2592 | Hepatitis B virus, subtype ayr | C | Core |
| CUST_P10010198 | 2516 | 2571 | 2593 | Hepatitis B virus, subtype ayr | C | Core |
| CUST_P10010199 | 2577 | 2636 | 2594 | Hepatitis B virus, subtype ayr | C | Core |
| CUST_P10010200 | 2629 | 2688 | 2595 | Hepatitis B virus, subtype ayr | C | Core |
| CUST_P10010201 | 2675 | 2734 | 2596 | Hepatitis B virus, subtype ayr | C | Core |
| CUST_P10010202 | 2702 | 2761 | 2597 | Hepatitis B virus, subtype ayr | C | Core |
| CUST_P10010203 | 2742 | 2801 | 2598 | Hepatitis B virus, subtype ayr | C | Core |
| CUST_P10010204 | 2890 | 2936 | 2599 | Hepatitis B virus, subtype ayr | S | surface protein |
| CUST_P10010205 | 2955 | 3001 | 2600 | Hepatitis B virus, subtype ayr | S | surface protein |
| CUST_P10010206 | 2978 | 3022 | 2601 | Hepatitis B virus, subtype ayr | S | surface protein |
| CUST_P10010207 | 3012 | 3056 | 2602 | Hepatitis B virus, subtype ayr | S | surface protein |
| CUST_P10010208 | 57 | 104 | 2603 | Human parvovirus B19 | NS | non-structural protein NS1 |
| CUST_P10010209 | 227 | 271 | 2604 | Human parvovirus B19 | NS | non-structural protein NS2 |
| CUST_P10010211 | 637 | 693 | 2605 | Human parvovirus B19 | NS | non-structural protein NS1 |
| CUST_P10010212 | 685 | 744 | 2606 | Human parvovirus B19 | NS | non-structural protein NS1 |
| CUST_P10010214 | 973 | 1032 | 2607 | Human parvovirus B19 | NS | non-structural protein NS1 |
| CUST_P10010215 | 1065 | 1124 | 2608 | Human parvovirus B19 | NS | non-structural protein NS1 |

TABLE 8-continued

Exemplary DNA virus probes

| ProbeID | Start | End | SEQ ID NO: | Virus | Genomic Region | Product |
|---|---|---|---|---|---|---|
| CUST_P10010216 | 1165 | 1210 | 2609 | Human parvovirus B19 | NS | non-structural protein NS1 |
| CUST_P10010217 | 1220 | 1279 | 2610 | Human parvovirus B19 | NS | non-structural protein NS1 |
| CUST_P10010218 | 1258 | 1317 | 2611 | Human parvovirus B19 | NS | non-structural protein NS1 |
| CUST_P10010219 | 1357 | 1416 | 2612 | Human parvovirus B19 | NS | non-structural protein NS1 |
| CUST_P10010220 | 1408 | 1467 | 2613 | Human parvovirus B19 | NS | non-structural protein NS1 |
| CUST_P10010221 | 1542 | 1601 | 2614 | Human parvovirus B19 | NS | non-structural protein NS1 |
| CUST_P10010222 | 1628 | 1687 | 2615 | Human parvovirus B19 | NS | non-structural protein NS1 |
| CUST_P10010223 | 1767 | 1812 | 2616 | Human parvovirus B19 | NS | non-structural protein NS1 |
| CUST_P10010224 | 1845 | 1902 | 2617 | Human parvovirus B19 | NS | non-structural protein NS1 |
| CUST_P10010225 | 1911 | 1970 | 2618 | Human parvovirus B19 | NS | non-structural protein NS1 |
| CUST_P10010226 | 2041 | 2096 | 2619 | Human parvovirus B19 | NS | non-structural protein NS1 |
| CUST_P10010227 | 2257 | 2301 | 2620 | Human parvovirus B19 | NS | non-structural protein NS1 |
| CUST_P10010228 | 2351 | 2399 | 2621 | Human parvovirus B19 | NS | non-structural protein NS1 |
| CUST_P10010229 | 2395 | 2446 | 2622 | Human parvovirus B19 | NS | non-structural protein NS1 |
| CUST_P10010230 | 2426 | 2478 | 2623 | Human parvovirus B19 | NS | non-structural protein NS1 |
| CUST_P10010231 | 2552 | 2607 | 2624 | Human parvovirus B19 | NS | non-structural protein NS1 |
| CUST_P10010232 | 2787 | 2846 | 2625 | Human parvovirus B19 | VP1 | minor capsid protein |
| CUST_P10010233 | 2836 | 2895 | 2626 | Human parvovirus B19 | VP1 | minor capsid protein |
| CUST_P10010234 | 2868 | 2915 | 2627 | Human parvovirus B19 | VP1 | minor capsid protein |
| CUST_P10010235 | 2914 | 2973 | 2628 | Human parvovirus B19 | VP1 | minor capsid protein |
| CUST_P10010236 | 3081 | 3140 | 2629 | Human parvovirus B19 | VP1 | minor capsid protein |
| CUST_P10010237 | 3252 | 3297 | 2630 | Human parvovirus B19 | VP1 | minor capsid protein |
| CUST_P10010238 | 3276 | 3330 | 2631 | Human parvovirus B19 | VP1 | minor capsid protein |
| CUST_P10010239 | 3422 | 3481 | 2632 | Human parvovirus B19 | VP1 | minor capsid protein |
| CUST_P10010240 | 3524 | 3583 | 2633 | Human parvovirus B19 | VP1 | minor capsid protein |
| CUST_P10010241 | 3652 | 3711 | 2634 | Human parvovirus B19 | VP1 | minor capsid protein |
| CUST_P10010242 | 3801 | 3856 | 2635 | Human parvovirus B19 | VP1 | minor capsid protein |
| CUST_P10010243 | 3826 | 3885 | 2636 | Human parvovirus B19 | VP1 | minor capsid protein |
| CUST_P10010244 | 3864 | 3923 | 2637 | Human parvovirus B19 | VP1 | minor capsid protein |
| CUST_P10010245 | 3996 | 4042 | 2638 | Human parvovirus B19 | VP1 | minor capsid protein |
| CUST_P10010246 | 4097 | 4156 | 2639 | Human parvovirus B19 | VP1 | minor capsid protein |
| CUST_P10010247 | 4334 | 4393 | 2640 | Human parvovirus B19 | VP1 | minor capsid protein |
| CUST_P10010248 | 4463 | 4522 | 2641 | Human parvovirus B19 | VP1 | minor capsid protein |
| CUST_P10010249 | 4587 | 4646 | 2642 | Human parvovirus B19 | VP1 | minor capsid protein |
| CUST_P10010250 | 4723 | 4782 | 2643 | Human parvovirus B19 | VP1 | minor capsid protein |
| CUST_P10010251 | 4820 | 4864 | 2644 | Human parvovirus B19 | VP1 | minor capsid protein |
| CUST_P10010252 | 4915 | 4960 | 2645 | Human parvovirus B19 | VP1 | minor capsid protein |

TABLE 8-continued

Exemplary DNA virus probes

| ProbeID | Start | End | SEQ ID NO: | Virus | Genomic Region | Product |
|---|---|---|---|---|---|---|
| CUST_P10010254 | 5087 | 5146 | 2646 | Human parvovirus B19 | VP2 | major capsid protein |
| CUST_P10010257 | 5492 | 5539 | 2647 | Human parvovirus B19 | VP2 | major capsid protein |

TABLE 9

Exemplary bacterial and protozoan probes

| SEQ ID NO: | ProbeID | Start | End | Pathogen | Genomic Region | Product |
|---|---|---|---|---|---|---|
| 2648 | CUST_P10011833 | 115100 | 115153 | *Treponema pallidum* | polA | Polymerase |
| 2649 | CUST_P10011835 | 115167 | 115219 | *Treponema pallidum* | polA | Polymerase |
| 2650 | CUST_P10011836 | 115187 | 115237 | *Treponema pallidum* | polA | Polymerase |
| 2651 | CUST_P10011838 | 115259 | 115314 | *Treponema pallidum* | polA | Polymerase |
| 2652 | CUST_P10011840 | 115554 | 115613 | *Treponema pallidum* | polA | Polymerase |
| 2653 | CUST_P10011841 | 115579 | 115638 | *Treponema pallidum* | polA | Polymerase |
| 2654 | CUST_P10011842 | 115605 | 115664 | *Treponema pallidum* | polA | Polymerase |
| 2655 | CUST_P10011843 | 115667 | 115716 | *Treponema pallidum* | polA | Polymerase |
| 2656 | CUST_P10011844 | 115696 | 115740 | *Treponema pallidum* | polA | Polymerase |
| 2657 | CUST_P10011845 | 115755 | 115807 | *Treponema pallidum* | polA | Polymerase |
| 2658 | CUST_P10011847 | 116076 | 116126 | *Treponema pallidum* | polA | Polymerase |
| 2659 | CUST_P10011848 | 116171 | 116223 | *Treponema pallidum* | polA | Polymerase |
| 2660 | CUST_P10011849 | 116242 | 116294 | *Treponema pallidum* | polA | Polymerase |
| 2661 | CUST_P10011850 | 116332 | 116384 | *Treponema pallidum* | polA | Polymerase |
| 2662 | CUST_P10011851 | 116352 | 116396 | *Treponema pallidum* | polA | Polymerase |
| 2663 | CUST_P10011852 | 116408 | 116459 | *Treponema pallidum* | polA | Polymerase |
| 2664 | CUST_P10011853 | 116430 | 116488 | *Treponema pallidum* | polA | Polymerase |
| 2665 | CUST_P10011854 | 116601 | 116649 | *Treponema pallidum* | polA | Polymerase |
| 2666 | CUST_P10011855 | 116623 | 116674 | *Treponema pallidum* | polA | Polymerase |
| 2667 | CUST_P10011856 | 116654 | 116713 | *Treponema pallidum* | polA | Polymerase |
| 2668 | CUST_P10011857 | 116677 | 116736 | *Treponema pallidum* | polA | Polymerase |
| 2669 | CUST_P10011858 | 116707 | 116760 | *Treponema pallidum* | polA | Polymerase |
| 2670 | CUST_P10011860 | 116852 | 116906 | *Treponema pallidum* | polA | Polymerase |
| 2671 | CUST_P10011862 | 116903 | 116962 | *Treponema pallidum* | polA | Polymerase |
| 2672 | CUST_P10011863 | 116925 | 116978 | *Treponema pallidum* | polA | Polymerase |
| 2673 | CUST_P10011864 | 116987 | 117032 | *Treponema pallidum* | polA | Polymerase |
| 2674 | CUST_P10011865 | 117028 | 117077 | *Treponema pallidum* | polA | Polymerase |
| 2675 | CUST_P10011866 | 117128 | 117176 | *Treponema pallidum* | polA | Polymerase |
| 2676 | CUST_P10011867 | 117270 | 117329 | *Treponema pallidum* | polA | Polymerase |
| 2677 | CUST_P10011868 | 117441 | 117488 | *Treponema pallidum* | polA | Polymerase |
| 2678 | CUST_P10011870 | 117516 | 117575 | *Treponema pallidum* | polA | Polymerase |
| 2679 | CUST_P10011871 | 117570 | 117620 | *Treponema pallidum* | polA | Polymerase |
| 2680 | CUST_P10011872 | 117777 | 117836 | *Treponema pallidum* | polA | Polymerase |
| 2681 | CUST_P10011873 | 117806 | 117865 | *Treponema pallidum* | polA | Polymerase |
| 2682 | CUST_P10011874 | 117873 | 117932 | *Treponema pallidum* | polA | Polymerase |
| 2683 | CUST_P10011875 | 118152 | 118211 | *Treponema pallidum* | polA | Polymerase |
| 2684 | CUST_P10011876 | 118181 | 118240 | *Treponema pallidum* | polA | Polymerase |
| 2685 | CUST_P10011877 | 118281 | 118340 | *Treponema pallidum* | polA | Polymerase |
| 2686 | CUST_P10011878 | 118302 | 118361 | *Treponema pallidum* | polA | Polymerase |
| 2687 | CUST_P10011880 | 118541 | 118600 | *Treponema pallidum* | polA | Polymerase |
| 2688 | CUST_P10011882 | 118756 | 118810 | *Treponema pallidum* | polA | Polymerase |
| 2689 | CUST_P10018873 | 622214 | 622258 | *Treponema pallidum* | TP0576 | protein |
| 2690 | CUST_P10018877 | 622589 | 622637 | *Treponema pallidum* | TP0576 | protein |
| 2691 | CUST_P10018878 | 622725 | 622775 | *Treponema pallidum* | TP0576 | protein |
| 2692 | CUST_P10018881 | 622908 | 622961 | *Treponema pallidum* | TP0576 | protein |
| 2693 | CUST_P10018882 | 622953 | 622997 | *Treponema pallidum* | TP0576 | protein |
| 2694 | CUST_P10018883 | 622978 | 623030 | *Treponema pallidum* | TP0576 | protein |
| 2695 | CUST_P10018884 | 623033 | 623087 | *Treponema pallidum* | TP0576 | protein |
| 2696 | CUST_P10018887 | 623258 | 623302 | *Treponema pallidum* | TP0576 | protein |
| 2697 | CUST_P10024966 | 1067780 | 1067830 | *Treponema pallidum* | aspS | aspartate-tRNA ligase |
| 2698 | CUST_P10024967 | 1067910 | 1067970 | *Treponema pallidum* | aspS | aspartate-tRNA ligase |
| 2699 | CUST_P10024968 | 1067940 | 1067990 | *Treponema pallidum* | aspS | aspartate-tRNA ligase |
| 2700 | CUST_P10024969 | 1068070 | 1068120 | *Treponema pallidum* | aspS | aspartate-tRNA ligase |
| 2701 | CUST_P10024970 | 1068180 | 1068230 | *Treponema pallidum* | aspS | aspartate-tRNA ligase |
| 2702 | CUST_P10024971 | 1068330 | 1068380 | *Treponema pallidum* | aspS | aspartate-tRNA ligase |
| 2703 | CUST_P10024972 | 1068410 | 1068470 | *Treponema pallidum* | aspS | aspartate-tRNA ligase |
| 2704 | CUST_P10024976 | 1068840 | 1068900 | *Treponema pallidum* | aspS | aspartate-tRNA ligase |
| 2705 | CUST_P10024981 | 1069090 | 1069140 | *Treponema pallidum* | aspS | aspartate-tRNA ligase |
| 2706 | CUST_P10024984 | 1069200 | 1069260 | *Treponema pallidum* | aspS | aspartate-tRNA ligase |

TABLE 9-continued

Exemplary bacterial and protozoan probes

| SEQ ID NO: | ProbeID | Start | End | Pathogen | Genomic Region | Product |
|---|---|---|---|---|---|---|
| 2707 | CUST_P10024986 | 1069380 | 1069420 | *Treponema pallidum* | aspS | aspartate-tRNA ligase |
| 2708 | CUST_P10024991 | 1069740 | 1069790 | *Treponema pallidum* | aspS | aspartate-tRNA ligase |
| 2709 | CUST_P10024994 | 1069890 | 1069940 | *Treponema pallidum* | aspS | aspartate-tRNA ligase |
| 2710 | CUST_P10024996 | 1070010 | 1070060 | *Treponema pallidum* | aspS | aspartate-tRNA ligase |
| 2711 | CUST_P10024997 | 1070040 | 1070080 | *Treponema pallidum* | aspS | aspartate-tRNA ligase |
| 2712 | CUST_P10024998 | 1070090 | 1070130 | *Treponema pallidum* | aspS | aspartate-tRNA ligase |
| 2713 | CUST_P10024999 | 1070140 | 1070190 | *Treponema pallidum* | aspS | aspartate-tRNA ligase |
| 2714 | CUST_P10025000 | 1070250 | 1070300 | *Treponema pallidum* | aspS | aspartate-tRNA ligase |
| 2715 | CUST_P10025003 | 1070380 | 1070430 | *Treponema pallidum* | aspS | aspartate-tRNA ligase |
| 2716 | CUST_P10025005 | 1070670 | 1070710 | *Treponema pallidum* | aspS | aspartate-tRNA ligase |
| 2717 | CUST_P10025006 | 1070800 | 1070850 | *Treponema pallidum* | TP0986 | protein |
| 2718 | CUST_P10025009 | 1071210 | 1071260 | *Treponema pallidum* | TP0986 | protein |
| 2719 | CUST_P10025010 | 1071230 | 1071290 | *Treponema pallidum* | TP0986 | protein |
| 2720 | CUST_P10025018 | 1071990 | 1072040 | *Treponema pallidum* | TP0986 | protein |
| 2721 | CUST_P10025019 | 1072210 | 1072260 | *Treponema pallidum* | TP0989 | protein |
| 2722 | CUST_P10025024 | 1072490 | 1072540 | *Treponema pallidum* | TP0989 | protein |
| 2723 | CUST_P10025027 | 1072660 | 1072710 | *Treponema pallidum* | TP0989 | protein |
| 2724 | CUST_P10025028 | 1072870 | 1072910 | *Treponema pallidum* | TP0989 | protein |
| 2725 | CUST_P10025029 | 1072990 | 1073040 | *Treponema pallidum* | TP0989 | protein |
| 2726 | CUST_P10025030 | 1073010 | 1073060 | *Treponema pallidum* | TP0989 | protein |
| 2727 | CUST_P10025044 | 1074070 | 1074120 | *Treponema pallidum* | TP0990 | protein |
| 2728 | CUST_P10025045 | 1074230 | 1074270 | *Treponema pallidum* | TP0991 | protein |
| 2729 | CUST_P10025047 | 1074310 | 1074360 | *Treponema pallidum* | TP0992 | protein |
| 2730 | CUST_P10025050 | 1074480 | 1074520 | *Treponema pallidum* | TP0993 | protein |
| 2731 | CUST_P10025051 | 1074520 | 1074560 | *Treponema pallidum* | TP0994 | protein |
| 2732 | CUST_P10025052 | 1074560 | 1074610 | *Treponema pallidum* | TP0995 | protein |
| 2733 | CUST_P10025054 | 1074620 | 1074670 | *Treponema pallidum* | TP0996 | protein |
| 2734 | CUST_P10025055 | 1074740 | 1074780 | *Treponema pallidum* | TP0997 | protein |
| 2735 | CUST_P10025056 | 1074790 | 1074830 | *Treponema pallidum* | TP0998 | protein |
| 2736 | CUST_P10025058 | 1075040 | 1075090 | *Treponema pallidum* | TP0999 | protein |
| 2737 | CUST_P10025059 | 1075150 | 1075210 | *Treponema pallidum* | TP1000 | protein |
| 2738 | CUST_P10025061 | 1075310 | 1075360 | *Treponema pallidum* | TP1001 | protein |
| 2739 | CUST_P10025062 | 1075380 | 1075430 | *Treponema pallidum* | TP1002 | protein |
| 2740 | CUST_P10025063 | 1075540 | 1075600 | *Treponema pallidum* | TP1003 | protein |
| 2741 | CUST_P10025064 | 1075600 | 1075640 | *Treponema pallidum* | TP1004 | protein |
| 2742 | CUST_P10025065 | 1075670 | 1075720 | *Treponema pallidum* | TP1005 | protein |
| 2743 | CUST_P10025067 | 1075970 | 1076030 | *Treponema pallidum* | TP1006 | protein |
| 2744 | CUST_P10025068 | 1076040 | 1076100 | *Treponema pallidum* | TP1007 | protein |
| 2745 | CUST_P10025069 | 1076170 | 1076220 | *Treponema pallidum* | TP0990 | protein |
| 2746 | CUST_P10025073 | 1076400 | 1076450 | *Treponema pallidum* | TP0991 | protein |
| 2747 | CUST_P10025084 | 1077230 | 1077280 | *Treponema pallidum* | TP0992 | protein |
| 2748 | CUST_P10025095 | 1077820 | 1077870 | *Treponema pallidum* | TP0992 | protein |
| 2749 | CUST_P10025097 | 1077980 | 1078030 | *Treponema pallidum* | TP0993 | protein |
| 2750 | CUST_P10025098 | 1078120 | 1078170 | *Treponema pallidum* | TP0993 | protein |
| 2751 | CUST_P10025104 | 1078320 | 1078370 | *Treponema pallidum* | TP0993 | protein |
| 2752 | CUST_P10025934 | 479 | 538 | *Ehrlichia chaffeensis* | ECH_RS00020 | protein |
| 2753 | CUST_P10026529 | 69254 | 69313 | *Ehrlichia chaffeensis* | argF | protein |
| 2754 | CUST_P10026957 | 118031 | 118090 | *Ehrlichia chaffeensis* | ECH_RS00525 | protein |
| 2755 | CUST_P10027106 | 133725 | 133784 | *Ehrlichia chaffeensis* | ECH_RS00595 | protein |
| 2756 | CUST_P10027296 | 155652 | 155711 | *Ehrlichia chaffeensis* | ECH_RS00695 | protein |
| 2757 | CUST_P10027314 | 158001 | 158060 | *Ehrlichia chaffeensis* | ECH_RS00710 | protein |
| 2758 | CUST_P10027972 | 235733 | 235792 | *Ehrlichia chaffeensis* | ECH_RS01035 | protein |
| 2759 | CUST_P10027973 | 235768 | 235827 | *Ehrlichia chaffeensis* | ECH_RS01035 | protein |
| 2760 | CUST_P10028360 | 279872 | 279931 | *Ehrlichia chaffeensis* | ECH_RS01185 | protein |
| 2761 | CUST_P10028636 | 313330 | 313389 | *Ehrlichia chaffeensis* | ECH_RS01325 | protein |
| 2762 | CUST_P10028976 | 353675 | 353734 | *Ehrlichia chaffeensis* | groL | chaperonin GroEL |
| 2763 | CUST_P10028977 | 353852 | 353911 | *Ehrlichia chaffeensis* | groL | chaperonin GroEL |
| 2764 | CUST_P10028978 | 354008 | 354067 | *Ehrlichia chaffeensis* | groL | chaperonin GroEL |
| 2765 | CUST_P10028979 | 354044 | 354103 | *Ehrlichia chaffeensis* | groL | chaperonin GroEL |
| 2766 | CUST_P10028980 | 354207 | 354266 | *Ehrlichia chaffeensis* | groL | chaperonin GroEL |
| 2767 | CUST_P10028981 | 354405 | 354464 | *Ehrlichia chaffeensis* | groL | chaperonin GroEL |
| 2768 | CUST_P10028982 | 354433 | 354492 | *Ehrlichia chaffeensis* | groL | chaperonin GroEL |
| 2769 | CUST_P10028983 | 354474 | 354533 | *Ehrlichia chaffeensis* | groL | chaperonin GroEL |
| 2770 | CUST_P10028984 | 354504 | 354563 | *Ehrlichia chaffeensis* | groL | chaperonin GroEL |
| 2771 | CUST_P10028985 | 354573 | 354632 | *Ehrlichia chaffeensis* | groL | chaperonin GroEL |
| 2772 | CUST_P10028986 | 354646 | 354694 | *Ehrlichia chaffeensis* | groL | chaperonin GroEL |
| 2773 | CUST_P10028987 | 354808 | 354867 | *Ehrlichia chaffeensis* | groL | chaperonin GroEL |
| 2774 | CUST_P10028988 | 354995 | 355054 | *Ehrlichia chaffeensis* | groL | chaperonin GroEL |
| 2775 | CUST_P10028989 | 355085 | 355144 | *Ehrlichia chaffeensis* | groL | chaperonin GroEL |
| 2776 | CUST_P10028990 | 355336 | 355395 | *Ehrlichia chaffeensis* | groL | chaperonin GroEL |
| 2777 | CUST_P10028991 | 355454 | 355508 | *Ehrlichia chaffeensis* | groL | chaperonin GroEL |
| 2778 | CUST_P10029114 | 369147 | 369206 | *Ehrlichia chaffeensis* | groL | chaperonin GroEL |
| 2779 | CUST_P10029290 | 392046 | 392105 | *Ehrlichia chaffeensis* | sppA | signal peptide |
| 2780 | CUST_P10029649 | 429284 | 429343 | *Ehrlichia chaffeensis* | ECH_RS01865 | Protein |

TABLE 9-continued

Exemplary bacterial and protozoan probes

| SEQ ID NO: | ProbeID | Start | End | Pathogen | Genomic Region | Product |
|---|---|---|---|---|---|---|
| 2781 | CUST_P10029666 | 431631 | 431690 | *Ehrlichia chaffeensis* | ECH_RS01866 | Protein |
| 2782 | CUST_P10029696 | 434789 | 434848 | *Ehrlichia chaffeensis* | ECH_RS01867 | Protein |
| 2783 | CUST_P10029724 | 437453 | 437512 | *Ehrlichia chaffeensis* | ECH_RS01868 | Protein |
| 2784 | CUST_P10030575 | 531280 | 531339 | *Ehrlichia chaffeensis* | ECH_RS01869 | Protein |
| 2785 | CUST_P10030591 | 532929 | 532988 | *Ehrlichia chaffeensis* | ECH_RS01870 | Protein |
| 2786 | CUST_P10030711 | 547792 | 547851 | *Ehrlichia chaffeensis* | ECH_RS01871 | Protein |
| 2787 | CUST_P10030738 | 551432 | 551491 | *Ehrlichia chaffeensis* | ECH_RS01872 | Protein |
| 2788 | CUST_P10030817 | 563329 | 563388 | *Ehrlichia chaffeensis* | ECH_RS01873 | Protein |
| 2789 | CUST_P10030998 | 588404 | 588463 | *Ehrlichia chaffeensis* | ECH_RS02440 | Protein |
| 2790 | CUST_P10031006 | 590051 | 590110 | *Ehrlichia chaffeensis* | ECH_RS02441 | Protein |
| 2791 | CUST_P10031019 | 591869 | 591928 | *Ehrlichia chaffeensis* | ECH_RS02442 | Protein |
| 2792 | CUST_P10031129 | 603725 | 603784 | *Ehrlichia chaffeensis* | ECH_RS02443 | Protein |
| 2793 | CUST_P10031152 | 607138 | 607197 | *Ehrlichia chaffeensis* | ECH_RS02444 | Protein |
| 2794 | CUST_P10031295 | 626729 | 626788 | *Ehrlichia chaffeensis* | ECH_RS02445 | Protein |
| 2795 | CUST_P10031314 | 628696 | 628755 | *Ehrlichia chaffeensis* | ECH_RS02446 | Protein |
| 2796 | CUST_P1OO3132O | 629770 | 629829 | *Ehrlichia chaffeensis* | ECH_RS02447 | Protein |
| 2797 | CUST_P10031396 | 640107 | 640166 | *Ehrlichia chaffeensis* | ECH_RS02448 | Protein |
| 2798 | CUST_P10031397 | 640131 | 640190 | *Ehrlichia chaffeensis* | ECH_RS02449 | Protein |
| 2799 | CUST_P10031498 | 651172 | 651231 | *Ehrlichia chaffeensis* | ECH_RS02450 | Protein |
| 2800 | CUST_P10031499 | 651236 | 651295 | *Ehrlichia chaffeensis* | ECH_RS02451 | Protein |
| 2801 | CUST_P10031500 | 651472 | 651531 | *Ehrlichia chaffeensis* | ECH_RS02452 | Protein |
| 2802 | CUST_P10031501 | 651648 | 651707 | *Ehrlichia chaffeensis* | ECH_RS02453 | Protein |
| 2803 | CUST_P10031502 | 651715 | 651774 | *Ehrlichia chaffeensis* | ECH_RS02454 | Protein |
| 2804 | CUST_P10031503 | 651749 | 651808 | *Ehrlichia chaffeensis* | ECH_RS02455 | Protein |
| 2805 | CUST_P10031504 | 651916 | 651975 | *Ehrlichia chaffeensis* | ECH_RS02456 | Protein |
| 2806 | CUST_P10031720 | 672910 | 672969 | *Ehrlichia chaffeensis* | ECH_RS02457 | Protein |
| 2807 | CUST_P10031846 | 688686 | 688745 | *Ehrlichia chaffeensis* | ECH_RS02458 | Protein |
| 2808 | CUST_P10031955 | 700839 | 700898 | *Ehrlichia chaffeensis* | ECH_RS02459 | Protein |
| 2809 | CUST_P10032107 | 718318 | 718377 | *Ehrlichia chaffeensis* | ECH_RS02460 | Protein |
| 2810 | CUST_P10032134 | 720951 | 721010 | *Ehrlichia chaffeensis* | ECH_RS02461 | Protein |
| 2811 | CUST_P10032155 | 723928 | 723987 | *Ehrlichia chaffeensis* | ECH_RS02462 | Protein |
| 2812 | CUST_P10032156 | 724045 | 724104 | *Ehrlichia chaffeensis* | ECH_RS02463 | Protein |
| 2813 | CUST_P10032157 | 724081 | 724140 | *Ehrlichia chaffeensis* | ECH_RS02464 | Protein |
| 2814 | CUST_P10032207 | 729136 | 729195 | *Ehrlichia chaffeensis* | ECH_RS02465 | Protein |
| 2815 | CUST_P10032413 | 753701 | 753760 | *Ehrlichia chaffeensis* | ECH_RS02466 | Protein |
| 2816 | CUST_P10032541 | 768672 | 768731 | *Ehrlichia chaffeensis* | ECH_RS02467 | Protein |
| 2817 | CUST_P10032560 | 770310 | 770369 | *Ehrlichia chaffeensis* | ECH_RS02468 | Protein |
| 2818 | CUST_P10032563 | 770754 | 770813 | *Ehrlichia chaffeensis* | ECH_RS02469 | Protein |
| 2819 | CUST_P10032708 | 789240 | 789299 | *Ehrlichia chaffeensis* | ECH_RS02470 | Protein |
| 2820 | CUST_P10032835 | 805456 | 805515 | *Ehrlichia chaffeensis* | ECH_RS02471 | Protein |
| 2821 | CUST_P10032934 | 816181 | 816240 | *Ehrlichia chaffeensis* | ECH_RS02472 | Protein |
| 2822 | CUST_P10032949 | 818626 | 818685 | *Ehrlichia chaffeensis* | ECH_RS02473 | Protein |
| 2823 | CUST_P10033029 | 827167 | 827226 | *Ehrlichia chaffeensis* | ECH_RS02474 | Protein |
| 2824 | CUST_P10033095 | 834972 | 835031 | *Ehrlichia chaffeensis* | ECH_RS02475 | Protein |
| 2825 | CUST_P10033283 | 854588 | 854647 | *Ehrlichia chaffeensis* | ECH_RS02476 | Protein |
| 2826 | CUST_P10033296 | 856372 | 856431 | *Ehrlichia chaffeensis* | ECH_RS02477 | Protein |
| 2827 | CUST_P10033303 | 858073 | 858132 | *Ehrlichia chaffeensis* | ECH_RS02478 | Protein |
| 2828 | CUST_P10033406 | 871304 | 871363 | *Ehrlichia chaffeensis* | ECH_RS02479 | Protein |
| 2829 | CUST_P10033442 | 875535 | 875594 | *Ehrlichia chaffeensis* | ECH_RS02480 | Protein |
| 2830 | CUST_P10033524 | 883572 | 883631 | *Ehrlichia chaffeensis* | ECH_RS02481 | Protein |
| 2831 | CUST_P10033559 | 887845 | 887904 | *Ehrlichia chaffeensis* | ECH_RS02482 | Protein |
| 2832 | CUST_P10033633 | 897694 | 897753 | *Ehrlichia chaffeensis* | ECH_RS02483 | Protein |
| 2833 | CUST_P10033864 | 922188 | 922247 | *Ehrlichia chaffeensis* | ECH_RS02484 | Protein |
| 2834 | CUST_P10033889 | 925077 | 925136 | *Ehrlichia chaffeensis* | ECH_RS02485 | Protein |
| 2835 | CUST_P10034084 | 946234 | 946293 | *Ehrlichia chaffeensis* | ECH_RS02486 | Protein |
| 2836 | CUST_P10034141 | 950852 | 950911 | *Ehrlichia chaffeensis* | ECH_RS02487 | Protein |
| 2837 | CUST_P10034279 | 966861 | 966920 | *Ehrlichia chaffeensis* | ECH_RS02488 | Protein |
| 2838 | CUST_P10034323 | 971540 | 971599 | *Ehrlichia chaffeensis* | ECH_RS02489 | Protein |
| 2839 | CUST_P10034725 | 1012370 | 1012430 | *Ehrlichia chaffeensis* | ECH_RS02490 | Protein |
| 2840 | CUST_P10034780 | 1018290 | 1018350 | *Ehrlichia chaffeensis* | ECH_RS02491 | Protein |
| 2841 | CUST_P10034783 | 1018550 | 1018610 | *Ehrlichia chaffeensis* | ECH_RS02492 | Protein |
| 2842 | CUST_P10034934 | 1034960 | 1035020 | *Ehrlichia chaffeensis* | ECH_RS02493 | Protein |
| 2843 | CUST_P10035002 | 1039980 | 1040040 | *Ehrlichia chaffeensis* | ECH_RS02494 | Protein |
| 2844 | CUST_P10035116 | 1053370 | 1053430 | *Ehrlichia chaffeensis* | ECH_RS02495 | Protein |
| 2845 | CUST_P10035418 | 1084080 | 1084130 | *Ehrlichia chaffeensis* | ECH_RS02496 | Protein |
| 2846 | CUST_P10035470 | 1089260 | 1089310 | *Ehrlichia chaffeensis* | ECH_RS02497 | Protein |
| 2847 | CUST_P10035547 | 1098110 | 1098170 | *Ehrlichia chaffeensis* | ECH_RS02498 | Protein |
| 2848 | CUST_P10035833 | 1129330 | 1129390 | *Ehrlichia chaffeensis* | ECH_RS02499 | Protein |
| 2849 | CUST_P10035846 | 1131120 | 1131180 | *Ehrlichia chaffeensis* | ECH_RS02500 | Protein |
| 2850 | CUST_P10036040 | 1151290 | 1151350 | *Ehrlichia chaffeensis* | ECH_RS02501 | Protein |
| 2851 | CUST_P10036201 | 1166620 | 1166680 | *Ehrlichia chaffeensis* | ECH_RS02502 | Protein |
| 2852 | CUST_P10036255 | 1172870 | 1172930 | *Ehrlichia chaffeensis* | ECH_RS02503 | Protein |
| 2853 | CUST_P10036280 | 37 | 96 | *Ehrlichia ewingii* | 16S ribosomal RNA | 16S ribosomal RNA |
| 2854 | CUST_P10036282 | 142 | 201 | *Ehrlichia ewingii* | 16S ribosomal RNA | 16S ribosomal RNA |

TABLE 9-continued

Exemplary bacterial and protozoan probes

| SEQ ID NO: | ProbeID | Start | End | Pathogen | Genomic Region | Product |
|---|---|---|---|---|---|---|
| 2855 | CUST_P10036288 | 828 | 872 | Ehrlichia ewingii | 16S ribosomal RNA | 16S ribosomal RNA |
| 2856 | CUST_P10036289 | 859 | 903 | Ehrlichia ewingii | 16S ribosomal RNA | 16S ribosomal RNA |
| 2857 | CUST_P10036290 | 885 | 938 | Ehrlichia ewingii | 16S ribosomal RNA | 16S ribosomal RNA |
| 2858 | CUST_P10036291 | 915 | 969 | Ehrlichia ewingii | 16S ribosomal RNA | 16S ribosomal RNA |
| 2859 | CUST_P10036293 | 1099 | 1144 | Ehrlichia ewingii | 16S ribosomal RNA | 16S ribosomal RNA |
| 2860 | CUST_P10036294 | 1120 | 1164 | Ehrlichia ewingii | 16S ribosomal RNA | 16S ribosomal RNA |
| 2861 | CUST_P10036296 | 1282 | 1328 | Ehrlichia ewingii | 16S ribosomal RNA | 16S ribosomal RNA |
| 2862 | CUST_P10041026 | 540829 | 540888 | Ehrlichia muris | 16S ribosomal RNA | 16S ribosomal RNA |
| 2863 | CUST_P10041027 | 540929 | 540988 | Ehrlichia muris | 16S ribosomal RNA | 16S ribosomal RNA |
| 2864 | CUST_P10041028 | 541043 | 541102 | Ehrlichia muris | 16S ribosomal RNA | 16S ribosomal RNA |
| 2865 | CUST_P10041029 | 541193 | 541252 | Ehrlichia muris | 16S ribosomal RNA | 16S ribosomal RNA |
| 2866 | CUST_P10041030 | 541329 | 541388 | Ehrlichia muris | 16S ribosomal RNA | 16S ribosomal RNA |
| 2867 | CUST_P10041031 | 541437 | 541496 | Ehrlichia muris | 16S ribosomal RNA | 16S ribosomal RNA |
| 2868 | CUST_P10041032 | 541659 | 541718 | Ehrlichia muris | 16S ribosomal RNA | 16S ribosomal RNA |
| 2869 | CUST_P10041033 | 541758 | 541817 | Ehrlichia muris | 16S ribosomal RNA | 16S ribosomal RNA |
| 2870 | CUST_P10038359 | 233191 | 233250 | Ehrlichia muris | 16S ribosomal RNA | 16S ribosomal RNA |
| 2871 | CUST_P10038360 | 233399 | 233458 | Ehrlichia muris | 16S ribosomal RNA | 16S ribosomal RNA |
| 2872 | CUST_P10038361 | 233444 | 233503 | Ehrlichia muris | 16S ribosomal RNA | 16S ribosomal RNA |
| 2873 | CUST_P10041027 | 540929 | 540988 | Ehrlichia muris | 16S ribosomal RNA | 16S ribosomal RNA |
| 2874 | CUST_P10041028 | 541043 | 541102 | Ehrlichia muris | 16S ribosomal RNA | 16S ribosomal RNA |
| 2875 | CUST_P10041029 | 541193 | 541252 | Ehrlichia muris | 16S ribosomal RNA | 16S ribosomal RNA |
| 2876 | CUST_P10041030 | 541329 | 541388 | Ehrlichia muris | 16S ribosomal RNA | 16S ribosomal RNA |
| 2877 | CUST_P10041031 | 541437 | 541496 | Ehrlichia muris | 16S ribosomal RNA | 16S ribosomal RNA |
| 2878 | CUST_P10041032 | 541659 | 541718 | Ehrlichia muris | 16S ribosomal RNA | 16S ribosomal RNA |
| 2879 | CUST_P10041771 | 642662 | 642721 | Ehrlichia muris | 16S ribosomal RNA | 16S ribosomal RNA |
| 2880 | CUST_P10041772 | 642918 | 642977 | Ehrlichia muris | 16S ribosomal RNA | 16S ribosomal RNA |
| 2881 | CUST_P10041773 | 642945 | 643004 | Ehrlichia muris | 16S ribosomal RNA | 16S ribosomal RNA |
| 2882 | CUST_P10041774 | 642970 | 643029 | Ehrlichia muris | 16S ribosomal RNA | 16S ribosomal RNA |
| 2883 | CUST_P10041775 | 642995 | 643054 | Ehrlichia muris | 16S ribosomal RNA | 16S ribosomal RNA |
| 2884 | CUST_P10041776 | 643229 | 643288 | Ehrlichia muris | 16S ribosomal RNA | 16S ribosomal RNA |
| 2885 | CUST_P10041777 | 643324 | 643383 | Ehrlichia muris | 16S ribosomal RNA | 16S ribosomal RNA |
| 2886 | CUST_P10041778 | 643453 | 643512 | Ehrlichia muris | 16S ribosomal RNA | 16S ribosomal RNA |
| 2887 | CUST_P10041779 | 643509 | 643562 | Ehrlichia muris | 16S ribosomal RNA | 16S ribosomal RNA |
| 2888 | CUST_P10041780 | 643629 | 643688 | Ehrlichia muris | 16S ribosomal RNA | 16S ribosomal RNA |
| 2889 | CUST_P10041784 | 644380 | 644439 | Ehrlichia muris | 16S ribosomal RNA | 16S ribosomal RNA |
| 2890 | CUST_P10041785 | 644514 | 644573 | Ehrlichia muris | 16S ribosomal RNA | 16S ribosomal RNA |
| 2891 | CUST_P10041786 | 644749 | 644808 | Ehrlichia muris | 16S ribosomal RNA | 16S ribosomal RNA |
| 2892 | CUST_P10041787 | 644886 | 644945 | Ehrlichia muris | 16S ribosomal RNA | 16S ribosomal RNA |
| 2893 | CUST_P10041788 | 645057 | 645116 | Ehrlichia muris | 16S ribosomal RNA | 16S ribosomal RNA |
| 2894 | CUST_P10041789 | 645158 | 645217 | Ehrlichia muris | 16S ribosomal RNA | 16S ribosomal RNA |
| 2895 | CUST_P10041790 | 645281 | 645340 | Ehrlichia muris | 16S ribosomal RNA | 16S ribosomal RNA |
| 2896 | CUST_P10041791 | 645374 | 645433 | Ehrlichia muris | 16S ribosomal RNA | 16S ribosomal RNA |
| 2897 | CUST_P10041792 | 645397 | 645456 | Ehrlichia muris | 16S ribosomal RNA | 16S ribosomal RNA |
| 2898 | CUST_P10044860 | 996657 | 996716 | Ehrlichia muris | 16S ribosomal RNA | 16S ribosomal RNA |
| 2899 | CUST_P10044861 | 996761 | 996820 | Ehrlichia muris | 16S ribosomal RNA | 16S ribosomal RNA |
| 2900 | CUST_P10044862 | 996859 | 996918 | Ehrlichia muris | 16S ribosomal RNA | 16S ribosomal RNA |
| 2901 | CUST_P10044863 | 996901 | 996960 | Ehrlichia muris | 16S ribosomal RNA | 16S ribosomal RNA |
| 2902 | CUST_P10044864 | 996958 | 997017 | Ehrlichia muris | 16S ribosomal RNA | 16S ribosomal RNA |
| 2903 | CUST_P10044865 | 996983 | 997042 | Ehrlichia muris | 16S ribosomal RNA | 16S ribosomal RNA |
| 2904 | CUST_P10044866 | 997035 | 997094 | Ehrlichia muris | 16S ribosomal RNA | 16S ribosomal RNA |
| 2905 | CUST_P10044867 | 997148 | 997207 | Ehrlichia muris | 16S ribosomal RNA | 16S ribosomal RNA |
| 2906 | CUST_P10044868 | 997264 | 997323 | Ehrlichia muris | 16S ribosomal RNA | 16S ribosomal RNA |
| 2907 | CUST_P10046461 | 1170365 | 1170424 | Ehrlichia muris | 16S ribosomal RNA | 16S ribosomal RNA |
| 2908 | CUST_P10046462 | 1170579 | 1170638 | Ehrlichia muris | 16S ribosomal RNA | 16S ribosomal RNA |
| 2909 | CUST_P10043391 | 833268 | 833320 | Ehrlichia muris | groL | chaperonin GroEL |
| 2910 | CUST_P10043392 | 833417 | 833476 | Ehrlichia muris | groL | chaperonin GroEL |
| 2911 | CUST_P10043393 | 833446 | 833505 | Ehrlichia muris | groL | chaperonin GroEL |
| 2912 | CUST_P10043394 | 833575 | 833634 | Ehrlichia muris | groL | chaperonin GroEL |
| 2913 | CUST_P10043395 | 833777 | 833833 | Ehrlichia muris | groL | chaperonin GroEL |
| 2914 | CUST_P10043396 | 833923 | 833982 | Ehrlichia muris | groL | chaperonin GroEL |
| 2915 | CUST_P10043397 | 834065 | 834124 | Ehrlichia muris | groL | chaperonin GroEL |
| 2916 | CUST_P10043398 | 834287 | 834346 | Ehrlichia muris | groL | chaperonin GroEL |
| 2917 | CUST_P10043399 | 834382 | 834441 | Ehrlichia muris | groL | chaperonin GroEL |
| 2918 | CUST_P10043400 | 834405 | 834464 | Ehrlichia muris | groL | chaperonin GroEL |
| 2919 | CUST_P10043401 | 834509 | 834568 | Ehrlichia muris | groL | chaperonin GroEL |
| 2920 | CUST_P10043402 | 834678 | 834737 | Ehrlichia muris | groL | chaperonin GroEL |
| 2921 | CUST_P10043403 | 834745 | 834804 | Ehrlichia muris | groL | chaperonin GroEL |
| 2922 | CUST_P10043404 | 834891 | 834950 | Ehrlichia muris | groL | chaperonin GroEL |
| 2923 | CUST_P10049214 | 444536 | 444595 | Borrelia burgdorferi | 16s | 16S ribosomal RNA |
| 2924 | CUST_P10049215 | 444623 | 444673 | Borrelia burgdorferi | 16s | 16S ribosomal RNA |
| 2925 | CUST_P10049216 | 444762 | 444821 | Borrelia burgdorferi | 16s | 16S ribosomal RNA |
| 2926 | CUST_P10049217 | 444920 | 444964 | Borrelia burgdorferi | 16s | 16S ribosomal RNA |
| 2927 | CUST_P10049218 | 444963 | 445012 | Borrelia burgdorferi | 16s | 16S ribosomal RNA |
| 2928 | CUST_P10049219 | 445091 | 445150 | Borrelia burgdorferi | 16s | 16S ribosomal RNA |

TABLE 9-continued

Exemplary bacterial and protozoan probes

| SEQ ID NO: | ProbeID | Start | End | Pathogen | Genomic Region | Product |
|---|---|---|---|---|---|---|
| 2929 | CUST_P10049220 | 445133 | 445179 | Borrelia burgdorferi | 16s | 16S ribosomal RNA |
| 2930 | CUST_P10049221 | 445305 | 445355 | Borrelia burgdorferi | 16s | 16S ribosomal RNA |
| 2931 | CUST_P10049222 | 445327 | 445373 | Borrelia burgdorferi | 16s | 16S ribosomal RNA |
| 2932 | CUST_P10049223 | 445379 | 445426 | Borrelia burgdorferi | 16s | 16S ribosomal RNA |
| 2933 | CUST_P10049224 | 445405 | 445464 | Borrelia burgdorferi | 16s | 16S ribosomal RNA |
| 2934 | CUST_P10049225 | 445428 | 445487 | Borrelia burgdorferi | 16s | 16S ribosomal RNA |
| 2935 | CUST_P10049226 | 445547 | 445591 | Borrelia burgdorferi | 16s | 16S ribosomal RNA |
| 2936 | CUST_P10049227 | 445605 | 445664 | Borrelia burgdorferi | 16s | 16S ribosomal RNA |
| 2937 | CUST_P10049228 | 445696 | 445740 | Borrelia burgdorferi | 16s | 16S ribosomal RNA |
| 2938 | CUST_P10049229 | 445821 | 445867 | Borrelia burgdorferi | 16s | 16S ribosomal RNA |
| 2939 | CUST_P10049230 | 445995 | 446040 | Borrelia burgdorferi | 16s | 16S ribosomal RNA |
| 2940 | CUST_P10049231 | 446027 | 446077 | Borrelia burgdorferi | 16s | 16S ribosomal RNA |
| 2941 | CUST_P10049138 | 435304 | 435363 | Borrelia burgdorferi | 23S | 23S ribosomal RNA |
| 2942 | CUST_P10049139 | 435400 | 435453 | Borrelia burgdorferi | 23S | 23S ribosomal RNA |
| 2943 | CUST_P10049140 | 435509 | 435553 | Borrelia burgdorferi | 23S | 23S ribosomal RNA |
| 2944 | CUST_P10049141 | 435580 | 435627 | Borrelia burgdorferi | 23S | 23S ribosomal RNA |
| 2945 | CUST_P10049142 | 435666 | 435710 | Borrelia burgdorferi | 23S | 23S ribosomal RNA |
| 2946 | CUST_P10049143 | 435821 | 435872 | Borrelia burgdorferi | 23S | 23S ribosomal RNA |
| 2947 | CUST_P10049144 | 435909 | 435958 | Borrelia burgdorferi | 23S | 23S ribosomal RNA |
| 2948 | CUST_P10049145 | 435971 | 436030 | Borrelia burgdorferi | 23S | 23S ribosomal RNA |
| 2949 | CUST_P10049146 | 436150 | 436201 | Borrelia burgdorferi | 23S | 23S ribosomal RNA |
| 2950 | CUST_P10049147 | 436235 | 436279 | Borrelia burgdorferi | 23S | 23S ribosomal RNA |
| 2951 | CUST_P10049148 | 436286 | 436334 | Borrelia burgdorferi | 23S | 23S ribosomal RNA |
| 2952 | CUST_P10049149 | 436313 | 436371 | Borrelia burgdorferi | 23S | 23S ribosomal RNA |
| 2953 | CUST_P10049150 | 436369 | 436413 | Borrelia burgdorferi | 23S | 23S ribosomal RNA |
| 2954 | CUST_P10049151 | 436388 | 436446 | Borrelia burgdorferi | 23S | 23S ribosomal RNA |
| 2955 | CUST_P10049152 | 436410 | 436469 | Borrelia burgdorferi | 23S | 23S ribosomal RNA |
| 2956 | CUST_P10049153 | 436512 | 436558 | Borrelia burgdorferi | 23S | 23S ribosomal RNA |
| 2957 | CUST_P10049154 | 436617 | 436676 | Borrelia burgdorferi | 23S | 23S ribosomal RNA |
| 2958 | CUST_P10049155 | 436713 | 436766 | Borrelia burgdorferi | 23S | 23S ribosomal RNA |
| 2959 | CUST_P10049156 | 436847 | 436891 | Borrelia burgdorferi | 23S | 23S ribosomal RNA |
| 2960 | CUST_P10049157 | 436877 | 436926 | Borrelia burgdorferi | 23S | 23S ribosomal RNA |
| 2961 | CUST_P10049158 | 436896 | 436952 | Borrelia burgdorferi | 23S | 23S ribosomal RNA |
| 2962 | CUST_P10049166 | 438226 | 438285 | Borrelia burgdorferi | 23S | 23S ribosomal RNA |
| 2963 | CUST_P10049167 | 438549 | 438608 | Borrelia burgdorferi | 23S | 23S ribosomal RNA |
| 2964 | CUST_P10049168 | 438645 | 438697 | Borrelia burgdorferi | 23S | 23S ribosomal RNA |
| 2965 | CUST_P10049169 | 438825 | 438872 | Borrelia burgdorferi | 23S | 23S ribosomal RNA |
| 2966 | CUST_P10049170 | 438911 | 438955 | Borrelia burgdorferi | 23S | 23S ribosomal RNA |
| 2967 | CUST_P10049171 | 439032 | 439076 | Borrelia burgdorferi | 23S | 23S ribosomal RNA |
| 2968 | CUST_P10049172 | 439154 | 439203 | Borrelia burgdorferi | 23S | 23S ribosomal RNA |
| 2969 | CUST_P10049173 | 439168 | 439212 | Borrelia burgdorferi | 23S | 23S ribosomal RNA |
| 2970 | CUST_P10049174 | 439245 | 439304 | Borrelia burgdorferi | 23S | 23S ribosomal RNA |
| 2971 | CUST_P10049175 | 439395 | 439446 | Borrelia burgdorferi | 23S | 23S ribosomal RNA |
| 2972 | CUST_P10049176 | 439480 | 439524 | Borrelia burgdorferi | 23S | 23S ribosomal RNA |
| 2973 | CUST_P10049177 | 439531 | 439579 | Borrelia burgdorferi | 23S | 23S ribosomal RNA |
| 2974 | CUST_P10049178 | 439558 | 439616 | Borrelia burgdorferi | 23S | 23S ribosomal RNA |
| 2975 | CUST_P10049179 | 439619 | 439664 | Borrelia burgdorferi | 23S | 23S ribosomal RNA |
| 2976 | CUST_P10049180 | 439633 | 439691 | Borrelia burgdorferi | 23S | 23S ribosomal RNA |
| 2977 | CUST_P10049181 | 439655 | 439714 | Borrelia burgdorferi | 23S | 23S ribosomal RNA |
| 2978 | CUST_P10049182 | 439757 | 439803 | Borrelia burgdorferi | 23S | 23S ribosomal RNA |
| 2979 | CUST_P10049183 | 439856 | 439915 | Borrelia burgdorferi | 23S | 23S ribosomal RNA |
| 2980 | CUST_P10049184 | 439958 | 440011 | Borrelia burgdorferi | 23S | 23S ribosomal RNA |
| 2981 | CUST_P10049185 | 440092 | 440136 | Borrelia burgdorferi | 23S | 23S ribosomal RNA |
| 2982 | CUST_P10049186 | 440122 | 440171 | Borrelia burgdorferi | 23S | 23S ribosomal RNA |
| 2983 | CUST_P10049187 | 440141 | 440197 | Borrelia burgdorferi | 23S | 23S ribosomal RNA |
| 2984 | CUST_P10049188 | 440177 | 440233 | Borrelia burgdorferi | 23S | 23S ribosomal RNA |
| 2985 | CUST_P10049189 | 440469 | 440528 | Borrelia burgdorferi | 23S | 23S ribosomal RNA |
| 2986 | CUST_P10049190 | 440564 | 440623 | Borrelia burgdorferi | 23S | 23S ribosomal RNA |
| 2987 | CUST_P10049191 | 440760 | 440811 | Borrelia burgdorferi | 23S | 23S ribosomal RNA |
| 2988 | CUST_P10049192 | 440807 | 440865 | Borrelia burgdorferi | 23S | 23S ribosomal RNA |
| 2989 | CUST_P10049193 | 440843 | 440896 | Borrelia burgdorferi | 23S | 23S ribosomal RNA |
| 2990 | CUST_P10049194 | 440888 | 440945 | Borrelia burgdorferi | 23S | 23S ribosomal RNA |
| 2991 | CUST_P10049195 | 441471 | 441530 | Borrelia burgdorferi | 23S | 23S ribosomal RNA |
| 2992 | CUST_P10047332 | 126269 | 126328 | Borrelia burgdorferi | recA | recombinase A |
| 2993 | CUST_P10047333 | 126457 | 126516 | Borrelia burgdorferi | recA | recombinase A |
| 2994 | CUST_P10047334 | 126609 | 126668 | Borrelia burgdorferi | recA | recombinase A |
| 2995 | CUST_P10047335 | 126748 | 126807 | Borrelia burgdorferi | recA | recombinase A |
| 2996 | CUST_P10047336 | 126867 | 126926 | Borrelia burgdorferi | recA | recombinase A |
| 2997 | CUST_P10047337 | 126934 | 126993 | Borrelia burgdorferi | recA | recombinase A |
| 2998 | CUST_P10047338 | 127133 | 127188 | Borrelia burgdorferi | recA | recombinase A |
| 2999 | CUST_P10047339 | 127173 | 127220 | Borrelia burgdorferi | recA | recombinase A |
| 3000 | CUST_P10047340 | 127196 | 127247 | Borrelia burgdorferi | recA | recombinase A |
| 3001 | CUST_P10047341 | 127219 | 127278 | Borrelia burgdorferi | recA | recombinase A |
| 3002 | CUST_P10051940 | 6651 | 6701 | Coxiella burnetii | IS1111A transposase | IS1111A transposase |

TABLE 9-continued

Exemplary bacterial and protozoan probes

| SEQ ID NO: | ProbeID | Start | End | Pathogen | Genomic Region | Product |
|---|---|---|---|---|---|---|
| 3003 | CUST_P10051941 | 6794 | 6851 | Coxiella burnetii | IS1111A transposase | IS1111A transposase |
| 3004 | CUST_P10051942 | 6831 | 6880 | Coxiella burnetii | IS1111A transposase | IS1111A transposase |
| 3005 | CUST_P10051943 | 6911 | 6955 | Coxiella burnetii | IS1111A transposase | IS1111A transposase |
| 3006 | CUST_P10051944 | 6942 | 6986 | Coxiella burnetii | IS1111A transposase | IS1111A transposase |
| 3007 | CUST_P10051945 | 6981 | 7034 | Coxiella burnetii | IS1111A transposase | IS1111A transposase |
| 3008 | CUST_P10051946 | 7090 | 7139 | Coxiella burnetii | IS1111A transposase | IS1111A transposase |
| 3009 | CUST_P10051947 | 7101 | 7154 | Coxiella burnetii | IS1111A transposase | IS1111A transposase |
| 3010 | CUST_P10051948 | 7164 | 7210 | Coxiella burnetii | IS1111A transposase | IS1111A transposase |
| 3011 | CUST_P10051949 | 7287 | 7337 | Coxiella burnetii | IS1111A transposase | IS1111A transposase |
| 3012 | CUST_P10051950 | 7318 | 7367 | Coxiella burnetii | IS1111A transposase | IS1111A transposase |
| 3013 | CUST_P10051951 | 7437 | 7483 | Coxiella burnetii | IS1111A transposase | IS1111A transposase |
| 3014 | CUST_P10051952 | 7459 | 7506 | Coxiella burnetii | IS1111A transposase | IS1111A transposase |
| 3015 | CUST_P10051953 | 7499 | 7544 | Coxiella burnetii | IS1111A transposase | IS1111A transposase |
| 3016 | CUST_P10051954 | 7516 | 7565 | Coxiella burnetii | IS1111A transposase | IS1111A transposase |
| 3017 | CUST_P10051955 | 7551 | 7603 | Coxiella burnetii | IS1111A transposase | IS1111A transposase |
| 3018 | CUST_P10051956 | 7660 | 7704 | Coxiella burnetii | IS1111A transposase | IS1111A transposase |
| 3019 | CUST_P10051957 | 7712 | 7763 | Coxiella burnetii | IS1111A transposase | IS1111A transposase |
| 3020 | CUST_P10051958 | 7817 | 7867 | Coxiella burnetii | IS1111A transposase | IS1111A transposase |
| 3021 | CUST_P10056626 | 345409 | 345458 | Coxiella burnetii | IS1111A transposase | IS1111A transposase |
| 3022 | CUST_P10056627 | 345420 | 345473 | Coxiella burnetii | IS1111A transposase | IS1111A transposase |
| 3023 | CUST_P10056628 | 345483 | 345529 | Coxiella burnetii | IS1111A transposase | IS1111A transposase |
| 3024 | CUST_P10056629 | 345606 | 345656 | Coxiella burnetii | IS1111A transposase | IS1111A transposase |
| 3025 | CUST_P10056630 | 345637 | 345686 | Coxiella burnetii | IS1111A transposase | IS1111A transposase |
| 3026 | CUST_P10056631 | 345756 | 345802 | Coxiella burnetii | IS1111A transposase | IS1111A transposase |
| 3027 | CUST_P10056632 | 345778 | 345825 | Coxiella burnetii | IS1111A transposase | IS1111A transposase |
| 3028 | CUST_P10056633 | 345818 | 345863 | Coxiella burnetii | IS1111A transposase | IS1111A transposase |
| 3029 | CUST_P10056634 | 345835 | 345884 | Coxiella burnetii | IS1111A transposase | IS1111A transposase |
| 3030 | CUST_P10056635 | 345870 | 345922 | Coxiella burnetii | IS1111A transposase | IS1111A transposase |
| 3031 | CUST_P10056636 | 345979 | 346023 | Coxiella burnetii | IS1111A transposase | IS1111A transposase |
| 3032 | CUST_P10056637 | 346031 | 346082 | Coxiella burnetii | IS1111A transposase | IS1111A transposase |
| 3033 | CUST_P10056638 | 346136 | 346186 | Coxiella burnetii | IS1111A transposase | IS1111A transposase |
| 3034 | CUST_P10058309 | 465895 | 465941 | Coxiella burnetii | IS1111A transposase | IS1111A transposase |
| 3035 | CUST_P10058310 | 465926 | 465970 | Coxiella burnetii | IS1111A transposase | IS1111A transposase |
| 3036 | CUST_P10058311 | 466027 | 466080 | Coxiella burnetii | IS1111A transposase | IS1111A transposase |
| 3037 | CUST_P10058312 | 466064 | 466113 | Coxiella burnetii | IS1111A transposase | IS1111A transposase |
| 3038 | CUST_P10058313 | 466123 | 466170 | Coxiella burnetii | IS1111A transposase | IS1111A transposase |
| 3039 | CUST_P10058314 | 466146 | 466192 | Coxiella burnetii | IS1111A transposase | IS1111A transposase |
| 3040 | CUST_P10058315 | 466263 | 466311 | Coxiella burnetii | IS1111A transposase | IS1111A transposase |
| 3041 | CUST_P10058316 | 466301 | 466354 | Coxiella burnetii | IS1111A transposase | IS1111A transposase |
| 3042 | CUST_P10058317 | 466422 | 466466 | Coxiella burnetii | IS1111A transposase | IS1111A transposase |
| 3043 | CUST_P10058318 | 466457 | 466504 | Coxiella burnetii | IS1111A transposase | IS1111A transposase |
| 3044 | CUST_P10058319 | 466479 | 466530 | Coxiella burnetii | IS1111A transposase | IS1111A transposase |
| 3045 | CUST_P10058320 | 466511 | 466555 | Coxiella burnetii | IS1111A transposase | IS1111A transposase |
| 3046 | CUST_P10058321 | 466595 | 466648 | Coxiella burnetii | IS1111A transposase | IS1111A transposase |
| 3047 | CUST_P10058322 | 466644 | 466688 | Coxiella burnetii | IS1111A transposase | IS1111A transposase |
| 3048 | CUST_P10058323 | 466684 | 466728 | Coxiella burnetii | IS1111A transposase | IS1111A transposase |
| 3049 | CUST_P10058324 | 466749 | 466798 | Coxiella burnetii | IS1111A transposase | IS1111A transposase |
| 3050 | CUST_P10058325 | 466778 | 466835 | Coxiella burnetii | IS1111A transposase | IS1111A transposase |
| 3051 | CUST_P10058326 | 466943 | 466999 | Coxiella burnetii | IS1111A transposase | IS1111A transposase |
| 3052 | CUST_P10058816 | 502390 | 502443 | Coxiella burnetii | IS1111A transposase | IS1111A transposase |
| 3053 | CUST_P10058817 | 502499 | 502548 | Coxiella burnetii | IS1111A transposase | IS1111A transposase |
| 3054 | CUST_P10058818 | 502510 | 502563 | Coxiella burnetii | IS1111A transposase | IS1111A transposase |
| 3055 | CUST_P10058819 | 502573 | 502619 | Coxiella burnetii | IS1111A transposase | IS1111A transposase |
| 3056 | CUST_P10058820 | 502696 | 502746 | Coxiella burnetii | IS1111A transposase | IS1111A transposase |
| 3057 | CUST_P10058821 | 502727 | 502776 | Coxiella burnetii | IS1111A transposase | IS1111A transposase |
| 3058 | CUST_P10058822 | 502846 | 502892 | Coxiella burnetii | IS1111A transposase | IS1111A transposase |
| 3059 | CUST_P10058823 | 502868 | 502915 | Coxiella burnetii | IS1111A transposase | IS1111A transposase |
| 3060 | CUST_P10058824 | 502908 | 502953 | Coxiella burnetii | IS1111A transposase | IS1111A transposase |
| 3061 | CUST_P10058825 | 502925 | 502974 | Coxiella burnetii | IS1111A transposase | IS1111A transposase |
| 3062 | CUST_P10058826 | 502960 | 503012 | Coxiella burnetii | IS1111A transposase | IS1111A transposase |
| 3063 | CUST_P10058827 | 503069 | 503113 | Coxiella burnetii | IS1111A transposase | IS1111A transposase |
| 3064 | CUST_P10058828 | 503121 | 503172 | Coxiella burnetii | IS1111A transposase | IS1111A transposase |
| 3065 | CUST_P10058829 | 503226 | 503276 | Coxiella burnetii | IS1111A transposase | IS1111A transposase |
| 3066 | CUST_P10058830 | 503308 | 503358 | Coxiella burnetii | IS1111A transposase | IS1111A transposase |
| 3067 | CUST_P10058831 | 503329 | 503384 | Coxiella burnetii | IS1111A transposase | IS1111A transposase |
| 3068 | CUST_P10058832 | 503374 | 503433 | Coxiella burnetii | IS1111A transposase | IS1111A transposase |
| 3069 | CUST_P10058833 | 503541 | 503597 | Coxiella burnetii | IS1111A transposase | IS1111A transposase |
| 3070 | CUST_P10058834 | 503609 | 503658 | Coxiella burnetii | IS1111A transposase | IS1111A transposase |
| 3071 | CUST_P10058835 | 503681 | 503725 | Coxiella burnetii | IS1111A transposase | IS1111A transposase |
| 3072 | CUST_P10058836 | 503718 | 503765 | Coxiella burnetii | IS1111A transposase | IS1111A transposase |
| 3073 | CUST_P10058837 | 503745 | 503791 | Coxiella burnetii | IS1111A transposase | IS1111A transposase |
| 3074 | CUST_P10058838 | 503852 | 503911 | Coxiella burnetii | IS1111A transposase | IS1111A transposase |
| 3075 | CUST_P10065644 | 1021442 | 1021488 | Coxiella burnetii | IS1111A transposase | IS1111A transposase |
| 3076 | CUST_P10065645 | 1021559 | 1021607 | Coxiella burnetii | IS1111A transposase | IS1111A transposase |

TABLE 9-continued

Exemplary bacterial and protozoan probes

| SEQ ID NO: | ProbeID | Start | End | Pathogen | Genomic Region | Product |
|---|---|---|---|---|---|---|
| 3077 | CUST_P10065646 | 1021597 | 1021650 | Coxiella burnetii | IS1111A transposase | IS1111A transposase |
| 3078 | CUST_P10065647 | 1021718 | 1021762 | Coxiella burnetii | IS1111A transposase | IS1111A transposase |
| 3079 | CUST_P10065648 | 1021753 | 1021800 | Coxiella burnetii | IS1111A transposase | IS1111A transposase |
| 3080 | CUST_P10065649 | 1021775 | 1021826 | Coxiella burnetii | IS1111A transposase | IS1111A transposase |
| 3081 | CUST_P10065650 | 1021807 | 1021851 | Coxiella burnetii | IS1111A transposase | IS1111A transposase |
| 3082 | CUST_P10065651 | 1021891 | 1021944 | Coxiella burnetii | IS1111A transposase | IS1111A transposase |
| 3083 | CUST_P10065652 | 1021940 | 1021984 | Coxiella burnetii | IS1111A transposase | IS1111A transposase |
| 3084 | CUST_P10065653 | 1021980 | 1022024 | Coxiella burnetii | IS1111A transposase | IS1111A transposase |
| 3085 | CUST_P10065654 | 1022045 | 1022094 | Coxiella burnetii | IS1111A transposase | IS1111A transposase |
| 3086 | CUST_P10079271 | 1019 | 1078 | Trypanosoma brucei | kinetoplast apocy | kinetoplast apocy |
| 3087 | CUST_P10079269 | 471 | 530 | Trypanosoma brucei | kinetoplast apocy | kinetoplast apocy |
| 3088 | CUST_P10079274 | 1363 | 1414 | Trypanosoma brucei | kinetoplast apocy | kinetoplast apocy |
| 3089 | CUST_P10079272 | 1279 | 1334 | Trypanosoma brucei | kinetoplast apocy | kinetoplast apocy |
| 3090 | CUST_P10079270 | 628 | 687 | Trypanosoma brucei | kinetoplast apocy | kinetoplast apocy |
| 3091 | CUST_P10079273 | 1329 | 1373 | Trypanosoma brucei | kinetoplast apocy | kinetoplast apocy |
| 3092 | CUST_P10079280 | 687 | 746 | Trypanosoma brucei | kinetoplast DNA m | kinetoplast DNA m |
| 3093 | CUST_P10079276 | 478 | 526 | Trypanosoma brucei | kinetoplast DNA m | kinetoplast DNA m |
| 3094 | CUST_P10079277 | 547 | 601 | Trypanosoma brucei | kinetoplast DNA m | kinetoplast DNA m |
| 3095 | CUST_P10079275 | 1 | 60 | Trypanosoma brucei | kinetoplast DNA m | kinetoplast DNA m |
| 3096 | CUST_P10079279 | 677 | 736 | Trypanosoma brucei | kinetoplast DNA m | kinetoplast DNA m |
| 3097 | CUST_P10079278 | 554 | 610 | Trypanosoma brucei | kinetoplast DNA m | kinetoplast DNA m |
| 3098 | CUST_P10079281 | 23 | 67 | Trypanosoma Cruzi | Mini satellite | Mini satellite |
| 3099 | CUST_P10079284 | 267 | 312 | Leishmania major | kinetoplast DNA | kinetoplast DNA |
| 3100 | CUST_P10079285 | 319 | 365 | Leishmania major | kinetoplast DNA | kinetoplast DNA |
| 3101 | CUST_P10079286 | 360 | 404 | Leishmania major | kinetoplast DNA | kinetoplast DNA |
| 3102 | CUST_P10079283 | 146 | 205 | Leishmania major | kinetoplast DNA | kinetoplast DNA |
| 3103 | CUST_P10079287 | 382 | 426 | Leishmania major | kinetoplast DNA | kinetoplast DNA |
| 3104 | CUST_P10079282 | 1 | 60 | Leishmania major | kinetoplast DNA | kinetoplast DNA |
| 3105 | CUST_P10079294 | 504 | 548 | Leishmania major | kinetoplast DNA | kinetoplast DNA |
| 3106 | CUST_P10079292 | 333 | 377 | Leishmania major | kinetoplast DNA | kinetoplast DNA |
| 3107 | CUST_P10079296 | 588 | 632 | Leishmania major | kinetoplast DNA | kinetoplast DNA |
| 3108 | CUST_P10079291 | 298 | 342 | Leishmania major | kinetoplast DNA | kinetoplast DNA |
| 3109 | CUST_P10079290 | 257 | 303 | Leishmania major | kinetoplast DNA | kinetoplast DNA |
| 3110 | CUST_P10079295 | 551 | 595 | Leishmania major | kinetoplast DNA | kinetoplast DNA |
| 3111 | CUST_P10079289 | 148 | 200 | Leishmania major | kinetoplast DNA | kinetoplast DNA |
| 3112 | CUST_P10079288 | 116 | 168 | Leishmania major | kinetoplast DNA | kinetoplast DNA |
| 3113 | CUST_P10079293 | 462 | 507 | Leishmania major | kinetoplast DNA | kinetoplast DNA |
| 3114 | CUST_P10079326 | 82 | 141 | Babesia microti | 18S ribosomal RNA | 18S ribosomal RNA |
| 3115 | CUST_P10079327 | 140 | 189 | Babesia microti | 18S ribosomal RNA | 18S ribosomal RNA |
| 3116 | CUST_P10079328 | 168 | 227 | Babesia microti | 18S ribosomal RNA | 18S ribosomal RNA |
| 3117 | CUST_P10079329 | 320 | 364 | Babesia microti | 18S ribosomal RNA | 18S ribosomal RNA |
| 3118 | CUST_P10079330 | 336 | 380 | Babesia microti | 18S ribosomal RNA | 18S ribosomal RNA |
| 3119 | CUST_P10079331 | 368 | 412 | Babesia microti | 18S ribosomal RNA | 18S ribosomal RNA |
| 3120 | CUST_P10079332 | 398 | 450 | Babesia microti | 18S ribosomal RNA | 18S ribosomal RNA |
| 3121 | CUST_P10079333 | 434 | 493 | Babesia microti | 18S ribosomal RNA | 18S ribosomal RNA |
| 3122 | CUST_P10079334 | 699 | 758 | Babesia microti | 18S ribosomal RNA | 18S ribosomal RNA |
| 3123 | CUST_P10079335 | 722 | 781 | Babesia microti | 18S ribosomal RNA | 18S ribosomal RNA |
| 3124 | CUST_P10079336 | 771 | 825 | Babesia microti | 18S ribosomal RNA | 18S ribosomal RNA |
| 3125 | CUST_P10079337 | 801 | 860 | Babesia microti | 18S ribosomal RNA | 18S ribosomal RNA |
| 3126 | CUST_P10079338 | 826 | 885 | Babesia microti | 18S ribosomal RNA | 18S ribosomal RNA |
| 3127 | CUST_P10079339 | 891 | 947 | Babesia microti | 18S ribosomal RNA | 18S ribosomal RNA |
| 3128 | CUST_P10079340 | 933 | 987 | Babesia microti | 18S ribosomal RNA | 18S ribosomal RNA |
| 3129 | CUST_P10079341 | 952 | 1006 | Babesia microti | 18S ribosomal RNA | 18S ribosomal RNA |
| 3130 | CUST_P10079342 | 990 | 1042 | Babesia microti | 18S ribosomal RNA | 18S ribosomal RNA |
| 3131 | CUST_P10079343 | 1016 | 1060 | Babesia microti | 18S ribosomal RNA | 18S ribosomal RNA |
| 3132 | CUST_P10079344 | 1055 | 1101 | Babesia microti | 18S ribosomal RNA | 18S ribosomal RNA |
| 3133 | CUST_P10079345 | 1108 | 1152 | Babesia microti | 18S ribosomal RNA | 18S ribosomal RNA |
| 3134 | CUST_P10079346 | 1239 | 1298 | Babesia microti | 18S ribosomal RNA | 18S ribosomal RNA |
| 3135 | CUST_P10079347 | 1357 | 1405 | Babesia microti | 18S ribosomal RNA | 18S ribosomal RNA |
| 3136 | CUST_P10079348 | 1435 | 1479 | Babesia microti | 18S ribosomal RNA | 18S ribosomal RNA |
| 3137 | CUST_P10079349 | 1458 | 1517 | Babesia microti | 18S ribosomal RNA | 18S ribosomal RNA |
| 3138 | CUST_P10079350 | 1620 | 1675 | Babesia microti | 18S ribosomal RNA | 18S ribosomal RNA |
| 3139 | CUST_P10079351 | 1659 | 1718 | Babesia microti | 18S ribosomal RNA | 18S ribosomal RNA |
| 3140 | CUST_P10079352 | 1736 | 1786 | Babesia microti | 18S ribosomal RNA | 18S ribosomal RNA |
| 3141 | CUST_P10079353 | 1758 | 1802 | Babesia microti | 18S ribosomal RNA | 18S ribosomal RNA |
| 3142 | CUST_P10079354 | 1811 | 1855 | Babesia microti | 18S ribosomal RNA | 18S ribosomal RNA |
| 3143 | CUST_P10079355 | 1845 | 1889 | Babesia microti | 18S ribosomal RNA | 18S ribosomal RNA |
| 3144 | CUST_P10079356 | 1894 | 1938 | Babesia microti | 18S ribosomal RNA | 18S ribosomal RNA |
| 3145 | CUST_P10079357 | 1914 | 1962 | Babesia microti | 18S ribosomal RNA | 18S ribosomal RNA |
| 3146 | CUST_P10079358 | 1947 | 1997 | Babesia microti | 18S ribosomal RNA | 18S ribosomal RNA |
| 3147 | CUST_P10079359 | 1975 | 2019 | Babesia microti | 18S ribosomal RNA | 18S ribosomal RNA |
| 3148 | CUST_P10079360 | 2034 | 2093 | Babesia microti | 18S ribosomal RNA | 18S ribosomal RNA |
| 3149 | CUST_P10079361 | 2056 | 2115 | Babesia microti | 18S ribosomal RNA | 18S ribosomal RNA |
| 3150 | CUST_P10079362 | 2125 | 2174 | Babesia microti | 18S ribosomal RNA | 18S ribosomal RNA |

TABLE 9-continued

Exemplary bacterial and protozoan probes

| SEQ ID NO: | ProbeID | Start | End | Pathogen | Genomic Region | Product |
|---|---|---|---|---|---|---|
| 3151 | CUST_P10079363 | 2266 | 2322 | Babesia microti | 18S ribosomal RNA | 18S ribosomal RNA |
| 3152 | CUST_P10079364 | 2342 | 2392 | Babesia microti | 18S ribosomal RNA | 18S ribosomal RNA |
| 3153 | CUST_P10079365 | 2363 | 2418 | Babesia microti | 18S ribosomal RNA | 18S ribosomal RNA |
| 3154 | CUST_P10079366 | 2389 | 2446 | Babesia microti | 18S ribosomal RNA | 18S ribosomal RNA |
| 3155 | CUST_P10079478 | 328 | 375 | Plasmodium falciparum | 18S ribosomal RNA | 18S ribosomal RNA |
| 3156 | CUST_P10079479 | 433 | 492 | Plasmodium falciparum | 18S ribosomal RNA | 18S ribosomal RNA |
| 3157 | CUST_P10079480 | 517 | 566 | Plasmodium falciparum | 18S ribosomal RNA | 18S ribosomal RNA |
| 3158 | CUST_P10079481 | 612 | 671 | Plasmodium falciparum | 18S ribosomal RNA | 18S ribosomal RNA |
| 3159 | CUST_P10079482 | 820 | 879 | Plasmodium falciparum | 18S ribosomal RNA | 18S ribosomal RNA |
| 3160 | CUST_P10079483 | 945 | 1003 | Plasmodium falciparum | 18S ribosomal RNA | 18S ribosomal RNA |
| 3161 | CUST_P10079484 | 971 | 1030 | Plasmodium falciparum | 18S ribosomal RNA | 18S ribosomal RNA |
| 3162 | CUST_P10079485 | 1018 | 1077 | Plasmodium falciparum | 18S ribosomal RNA | 18S ribosomal RNA |
| 3163 | CUST_P10079486 | 1211 | 1257 | Plasmodium falciparum | 18S ribosomal RNA | 18S ribosomal RNA |
| 3164 | CUST_P10079487 | 1284 | 1343 | Plasmodium falciparum | 18S ribosomal RNA | 18S ribosomal RNA |
| 3165 | CUST_P10079488 | 1386 | 1445 | Plasmodium falciparum | 18S ribosomal RNA | 18S ribosomal RNA |
| 3166 | CUST_P10079489 | 1673 | 1727 | Plasmodium falciparum | 18S ribosomal RNA | 18S ribosomal RNA |
| 3167 | CUST_P10079490 | 1817 | 1876 | Plasmodium falciparum | 18S ribosomal RNA | 18S ribosomal RNA |
| 3168 | CUST_P10079491 | 1852 | 1911 | Plasmodium falciparum | 18S ribosomal RNA | 18S ribosomal RNA |
| 3169 | CUST_P10079492 | 70 | 129 | Plasmodium falciparum | 18S ribosomal RNA | 18S ribosomal RNA |
| 3170 | CUST_P10079493 | 321 | 373 | Plasmodium falciparum | 18S ribosomal RNA | 18S ribosomal RNA |
| 3171 | CUST_P10079494 | 460 | 519 | Plasmodium falciparum | 18S ribosomal RNA | 18S ribosomal RNA |
| 3172 | CUST_P10079495 | 489 | 548 | Plasmodium falciparum | 18S ribosomal RNA | 18S ribosomal RNA |
| 3173 | CUST_P10079496 | 519 | 569 | Plasmodium falciparum | 18S ribosomal RNA | 18S ribosomal RNA |
| 3174 | CUST_P10079497 | 599 | 658 | Plasmodium falciparum | 18S ribosomal RNA | 18S ribosomal RNA |
| 3175 | CUST_P10079498 | 800 | 859 | Plasmodium falciparum | 18S ribosomal RNA | 18S ribosomal RNA |
| 3176 | CUST_P10079499 | 826 | 885 | Plasmodium falciparum | 18S ribosomal RNA | 18S ribosomal RNA |
| 3177 | CUST_P10079500 | 990 | 1046 | Plasmodium falciparum | 18S ribosomal RNA | 18S ribosomal RNA |
| 3178 | CUST_P10079501 | 1014 | 1073 | Plasmodium falciparum | 18S ribosomal RNA | 18S ribosomal RNA |
| 3179 | CUST_P10079502 | 1053 | 1112 | Plasmodium falciparum | 18S ribosomal RNA | 18S ribosomal RNA |
| 3180 | CUST_P10079503 | 1264 | 1310 | Plasmodium falciparum | 18S ribosomal RNA | 18S ribosomal RNA |
| 3181 | CUST_P10079504 | 1332 | 1391 | Plasmodium falciparum | 18S ribosomal RNA | 18S ribosomal RNA |
| 3182 | CUST_P10079505 | 1450 | 1509 | Plasmodium falciparum | 18S ribosomal RNA | 18S ribosomal RNA |
| 3183 | CUST_P10079506 | 1721 | 1770 | Plasmodium falciparum | 18S ribosomal RNA | 18S ribosomal RNA |
| 3184 | CUST_P10079507 | 1742 | 1801 | Plasmodium falciparum | 18S ribosomal RNA | 18S ribosomal RNA |
| 3185 | CUST_P10079508 | 1890 | 1949 | Plasmodium falciparum | 18S ribosomal RNA | 18S ribosomal RNA |
| 3186 | CUST_P10079572 | 2 | 61 | Plasmodium vivax | SSU rRNA | external transcribed spacer |
| 3187 | CUST_P10079573 | 38 | 89 | Plasmodium vivax | SSU rRNA | external transcribed spacer |
| 3188 | CUST_P10079574 | 68 | 127 | Plasmodium vivax | SSU rRNA | external transcribed spacer |
| 3189 | CUST_P10079575 | 112 | 171 | Plasmodium vivax | SSU rRNA | external transcribed spacer |
| 3190 | CUST_P10079576 | 249 | 308 | Plasmodium vivax | SSU rRNA | external transcribed spacer |
| 3191 | CUST_P10079577 | 279 | 338 | Plasmodium vivax | SSU rRNA | external transcribed spacer |
| 3192 | CUST_P10079578 | 319 | 372 | Plasmodium vivax | SSU rRNA | external transcribed spacer |
| 3193 | CUST_P10079579 | 421 | 480 | Plasmodium vivax | SSU rRNA | external transcribed spacer |
| 3194 | CUST_P10079580 | 590 | 645 | Plasmodium vivax | SSU rRNA | external transcribed spacer |
| 3195 | CUST_P10079581 | 671 | 719 | Plasmodium vivax | SSU rRNA | external transcribed spacer |
| 3196 | CUST_P10079582 | 783 | 842 | Plasmodium vivax | SSU rRNA | external transcribed spacer |
| 3197 | CUST_P10079583 | 803 | 862 | Plasmodium vivax | SSU rRNA | external transcribed spacer |
| 3198 | CUST_P10079584 | 829 | 888 | Plasmodium vivax | SSU rRNA | external transcribed spacer |
| 3199 | CUST_P10079585 | 849 | 899 | Plasmodium vivax | SSU rRNA | external transcribed spacer |
| 3200 | CUST_P10079586 | 946 | 1005 | Plasmodium vivax | SSU rRNA | external transcribed spacer |
| 3201 | CUST_P10079587 | 1153 | 1212 | Plasmodium vivax | SSU rRNA | external transcribed spacer |
| 3202 | CUST_P10079588 | 1314 | 1373 | Plasmodium vivax | SSU rRNA | external transcribed spacer |
| 3203 | CUST_P10079589 | 1346 | 1405 | Plasmodium vivax | SSU rRNA | external transcribed spacer |
| 3204 | CUST_P10079590 | 1545 | 1591 | Plasmodium vivax | SSU rRNA | external transcribed spacer |
| 3205 | CUST_P10079591 | 1610 | 1669 | Plasmodium vivax | SSU rRNA | external transcribed spacer |
| 3206 | CUST_P10079592 | 1717 | 1776 | Plasmodium vivax | SSU rRNA | external transcribed spacer |
| 3207 | CUST_P10079593 | 1757 | 1816 | Plasmodium vivax | SSU rRNA | external transcribed spacer |

TABLE 10

Exemplary control probes

| SEQ ID NO: | ProbeID | Start | End | Type | Genomic Region |
|---|---|---|---|---|---|
| 3208 | CUST_P10079594 | 1561 | 1605 | Housekeeping Gene | ACTB |
| 3209 | CUST_P10079595 | 1703 | 1750 | Housekeeping Gene | ACTB |
| 3210 | CUST_P10079596 | 2220 | 2264 | Housekeeping Gene | ACTB |
| 3211 | CUST_P10079597 | 2242 | 2286 | Housekeeping Gene | ACTB |
| 3212 | CUST_P10079598 | 2276 | 2320 | Housekeeping Gene | ACTB |
| 3213 | CUST_P10079599 | 2402 | 2446 | Housekeeping Gene | ACTB |

TABLE 10-continued

Exemplary control probes

| SEQ ID NO: | ProbeID | Start | End | Type | Genomic Region |
|---|---|---|---|---|---|
| 3214 | CUST_P10079600 | 2489 | 2533 | Housekeeping Gene | ACTB |
| 3215 | CUST_P10079601 | 2659 | 2703 | Housekeeping Gene | ACTB |
| 3216 | CUST_P10079602 | 2696 | 2740 | Housekeeping Gene | ACTB |
| 3217 | CUST_P10079603 | 2823 | 2867 | Housekeeping Gene | ACTB |
| 3218 | CUST_P10079604 | 2847 | 2891 | Housekeeping Gene | ACTB |
| 3219 | CUST_P10079605 | 2874 | 2918 | Housekeeping Gene | ACTB |
| 3220 | CUST_P10079606 | 3005 | 3049 | Housekeeping Gene | ACTB |
| 3221 | CUST_P10079607 | 3046 | 3090 | Housekeeping Gene | ACTB |
| 3222 | CUST_P10079608 | 3213 | 3257 | Housekeeping Gene | ACTB |
| 3223 | CUST_P10079609 | 3338 | 3382 | Housekeeping Gene | ACTB |
| 3224 | CUST_P10079610 | 3376 | 3420 | Housekeeping Gene | ACTB |
| 3225 | CUST_P10079611 | 3393 | 3437 | Housekeeping Gene | ACTB |
| 3226 | CUST_P10079612 | 3438 | 3482 | Housekeeping Gene | ACTB |
| 3227 | CUST_P10079613 | 3545 | 3593 | Housekeeping Gene | ACTB |
| 3228 | CUST_P10079614 | 3568 | 3622 | Housekeeping Gene | ACTB |
| 3229 | CUST_P10079615 | 3601 | 3645 | Housekeeping Gene | ACTB |
| 3230 | CUST_P10079616 | 3744 | 3788 | Housekeeping Gene | ACTB |
| 3231 | CUST_P10079617 | 3858 | 3902 | Housekeeping Gene | ACTB |
| 3232 | CUST_P10079618 | 3973 | 4017 | Housekeeping Gene | ACTB |
| 3233 | CUST_P10079619 | 4130 | 4177 | Housekeeping Gene | ACTB |
| 3234 | CUST_P10079620 | 4223 | 4267 | Housekeeping Gene | ACTB |
| 3235 | CUST_P10079621 | 4280 | 4324 | Housekeeping Gene | ACTB |
| 3236 | CUST_P10079622 | 4304 | 4348 | Housekeeping Gene | ACTB |
| 3237 | CUST_P10079623 | 4315 | 4359 | Housekeeping Gene | ACTB |
| 3238 | CUST_P10079624 | 4459 | 4503 | Housekeeping Gene | ACTB |
| 3239 | CUST_P10079625 | 4592 | 4636 | Housekeeping Gene | ACTB |
| 3240 | CUST_P10079626 | 4906 | 4950 | Housekeeping Gene | ACTB |
| 3241 | CUST_P10079627 | 4932 | 4978 | Housekeeping Gene | ACTB |
| 3242 | CUST_P10079628 | 4972 | 5016 | Housekeeping Gene | ACTB |
| 3243 | CUST_P10079629 | 5024 | 5068 | Housekeeping Gene | ACTB |
| 3244 | CUST_P10079630 | 5040 | 5084 | Housekeeping Gene | ACTB |
| 3245 | CUST_P10079631 | 5076 | 5120 | Housekeeping Gene | ACTB |
| 3246 | CUST_P10079632 | 5110 | 5154 | Housekeeping Gene | ACTB |
| 3247 | CUST_P10079633 | 5200 | 5244 | Housekeeping Gene | ACTB |
| 3248 | CUST_P10079634 | 5357 | 5401 | Housekeeping Gene | ACTB |
| 3249 | CUST_P10079635 | 5390 | 5434 | Housekeeping Gene | ACTB |
| 3250 | CUST_P10079636 | 5415 | 5459 | Housekeeping Gene | ACTB |
| 3251 | CUST_P10079637 | 5453 | 5497 | Housekeeping Gene | ACTB |
| 3252 | CUST_P10079638 | 5474 | 5518 | Housekeeping Gene | ACTB |
| 3253 | CUST_P10079639 | 5622 | 5666 | Housekeeping Gene | ACTB |
| 3254 | CUST_P10079640 | 5662 | 5706 | Housekeeping Gene | ACTB |
| 3255 | CUST_P10079641 | 5691 | 5736 | Housekeeping Gene | ACTB |
| 3256 | CUST_P10079642 | 5712 | 5756 | Housekeeping Gene | ACTB |
| 3257 | CUST_P10079643 | 5760 | 5804 | Housekeeping Gene | ACTB |
| 3258 | CUST_P10079644 | 5783 | 5827 | Housekeeping Gene | ACTB |
| 3259 | CUST_P10079645 | 5817 | 5861 | Housekeeping Gene | ACTB |
| 3260 | CUST_P10079646 | 5963 | 6007 | Housekeeping Gene | ACTB |
| 3261 | CUST_P10079647 | 6004 | 6048 | Housekeeping Gene | ACTB |
| 3262 | CUST_P10079648 | 6106 | 6150 | Housekeeping Gene | ACTB |
| 3263 | CUST_P10079649 | 6310 | 6354 | Housekeeping Gene | ACTB |
| 3264 | CUST_P10079650 | 6421 | 6465 | Housekeeping Gene | ACTB |
| 3265 | CUST_P10079651 | 6507 | 6553 | Housekeeping Gene | ACTB |
| 3266 | CUST_P10079652 | 6696 | 6740 | Housekeeping Gene | ACTB |
| 3267 | CUST_P10079653 | 6722 | 6769 | Housekeeping Gene | ACTB |
| 3268 | CUST_P10079654 | 6745 | 6789 | Housekeeping Gene | ACTB |
| 3269 | CUST_P10079655 | 6772 | 6816 | Housekeeping Gene | ACTB |
| 3270 | CUST_P10079656 | 6793 | 6837 | Housekeeping Gene | ACTB |
| 3271 | CUST_P10079657 | 6844 | 6888 | Housekeeping Gene | ACTB |
| 3272 | CUST_P10079658 | 7000 | 7044 | Housekeeping Gene | ACTB |
| 3273 | CUST_P10079659 | 7321 | 7365 | Housekeeping Gene | ACTB |
| 3274 | CUST_P10079660 | 7418 | 7462 | Housekeeping Gene | ACTB |
| 3275 | CUST_P10079661 | 7554 | 7598 | Housekeeping Gene | ACTB |
| 3276 | CUST_P10079662 | 7683 | 7727 | Housekeeping Gene | ACTB |
| 3277 | CUST_P10079663 | 7777 | 7821 | Housekeeping Gene | ACTB |
| 3278 | CUST_P10079664 | 7825 | 7869 | Housekeeping Gene | ACTB |
| 3279 | CUST_P10079665 | 7861 | 7917 | Housekeeping Gene | ACTB |
| 3280 | CUST_P10079666 | 8033 | 8077 | Housekeeping Gene | ACTB |
| 3281 | CUST_P10079667 | 8138 | 8182 | Housekeeping Gene | ACTB |
| 3282 | CUST_P10079668 | 8344 | 8388 | Housekeeping Gene | ACTB |
| 3283 | CUST_P10079669 | 8459 | 8503 | Housekeeping Gene | ACTB |
| 3284 | CUST_P10079670 | 8519 | 8563 | Housekeeping Gene | ACTB |
| 3285 | CUST_P10079671 | 8543 | 8587 | Housekeeping Gene | ACTB |
| 3286 | CUST_P10079672 | 8574 | 8618 | Housekeeping Gene | ACTB |
| 3287 | CUST_P10079673 | 8628 | 8672 | Housekeeping Gene | ACTB |
| 3288 | CUST_P10079674 | 8732 | 8776 | Housekeeping Gene | ACTB |

TABLE 10-continued

Exemplary control probes

| SEQ ID NO: | ProbeID | Start | End | Type | Genomic Region |
|---|---|---|---|---|---|
| 3289 | CUST_P10079675 | 8941 | 8985 | Housekeeping Gene | ACTB |
| 3290 | CUST_P10079676 | 8962 | 9006 | Housekeeping Gene | ACTB |
| 3291 | CUST_P10079677 | 8987 | 9031 | Housekeeping Gene | ACTB |
| 3292 | CUST_P10079678 | 9103 | 9147 | Housekeeping Gene | ACTB |
| 3293 | CUST_P10079679 | 9155 | 9199 | Housekeeping Gene | ACTB |
| 3294 | CUST_P10079680 | 9429 | 9474 | Housekeeping Gene | ACTB |
| 3295 | CUST_P10079681 | 9554 | 9600 | Housekeeping Gene | ACTB |
| 3296 | CUST_P10079682 | 9739 | 9785 | Housekeeping Gene | ACTB |
| 3297 | CUST_P10079683 | 9774 | 9820 | Housekeeping Gene | ACTB |
| 3298 | CUST_P10079684 | 9794 | 9838 | Housekeeping Gene | ACTB |
| 3299 | CUST_P10079685 | 10015 | 10062 | Housekeeping Gene | ACTB |
| 3300 | CUST_P10079686 | 10064 | 10108 | Housekeeping Gene | ACTB |
| 3301 | CUST_P10079687 | 10193 | 10245 | Housekeeping Gene | ACTB |
| 3302 | CUST_P10079715 | 3325 | 3369 | Housekeeping Gene | ARL1 |
| 3303 | CUST_P10079713 | 3255 | 3314 | Housekeeping Gene | ARL1 |
| 3304 | CUST_P10079727 | 5957 | 6016 | Housekeeping Gene | ARL1 |
| 3305 | CUST_P10079741 | 10779 | 10838 | Housekeeping Gene | ARL1 |
| 3306 | CUST_P10079759 | 13558 | 13604 | Housekeeping Gene | ARL1 |
| 3307 | CUST_P10079701 | 934 | 979 | Housekeeping Gene | ARL1 |
| 3308 | CUST_P10079692 | 526 | 570 | Housekeeping Gene | ARL1 |
| 3309 | CUST_P10079750 | 11884 | 11939 | Housekeeping Gene | ARL1 |
| 3310 | CUST_P10079730 | 6728 | 6787 | Housekeeping Gene | ARL1 |
| 3311 | CUST_P10079746 | 11349 | 11397 | Housekeeping Gene | ARL1 |
| 3312 | CUST_P10079744 | 11307 | 11354 | Housekeeping Gene | ARL1 |
| 3313 | CUST_P10079732 | 7235 | 7286 | Housekeeping Gene | ARL1 |
| 3314 | CUST_P10079733 | 7270 | 7314 | Housekeeping Gene | ARL1 |
| 3315 | CUST_P10079760 | 13597 | 13641 | Housekeeping Gene | ARL1 |
| 3316 | CUST_P10079762 | 13648 | 13693 | Housekeeping Gene | ARL1 |
| 3317 | CUST_P10079758 | 13449 | 13508 | Housekeeping Gene | ARL1 |
| 3318 | CUST_P10079728 | 6518 | 6577 | Housekeeping Gene | ARL1 |
| 3319 | CUST_P10079738 | 9891 | 9950 | Housekeeping Gene | ARL1 |
| 3320 | CUST_P10079742 | 10939 | 10998 | Housekeeping Gene | ARL1 |
| 3321 | CUST_P10079696 | 746 | 796 | Housekeeping Gene | ARL1 |
| 3322 | CUST_P10079703 | 1025 | 1079 | Housekeeping Gene | ARL1 |
| 3323 | CUST_P10079688 | 137 | 181 | Housekeeping Gene | ARL1 |
| 3324 | CUST_P10079755 | 12703 | 12762 | Housekeeping Gene | ARL1 |
| 3325 | CUST_P10079748 | 11728 | 11787 | Housekeeping Gene | ARL1 |
| 3326 | CUST_P10079722 | 5055 | 5114 | Housekeeping Gene | ARL1 |
| 3327 | CUST_P10079724 | 5213 | 5268 | Housekeeping Gene | ARL1 |
| 3328 | CUST_P10079736 | 8842 | 8901 | Housekeeping Gene | ARL1 |
| 3329 | CUST_P10079714 | 3291 | 3350 | Housekeeping Gene | ARL1 |
| 3330 | CUST_P10079726 | 5923 | 5982 | Housekeeping Gene | ARL1 |
| 3331 | CUST_P10079735 | 8610 | 8669 | Housekeeping Gene | ARL1 |
| 3332 | CUST_P10079739 | 10525 | 10584 | Housekeeping Gene | ARL1 |
| 3333 | CUST_P10079747 | 11552 | 11599 | Housekeeping Gene | ARL1 |
| 3334 | CUST_P10079753 | 12428 | 12487 | Housekeeping Gene | ARL1 |
| 3335 | CUST_P10079768 | 14112 | 14158 | Housekeeping Gene | ARL1 |
| 3336 | CUST_P10079690 | 310 | 354 | Housekeeping Gene | ARL1 |
| 3337 | CUST_P10079691 | 435 | 483 | Housekeeping Gene | ARL1 |
| 3338 | CUST_P10079702 | 977 | 1028 | Housekeeping Gene | ARL1 |
| 3339 | CUST_P10079689 | 209 | 253 | Housekeeping Gene | ARL1 |
| 3340 | CUST_P10079743 | 11265 | 11317 | Housekeeping Gene | ARL1 |
| 3341 | CUST_P10079745 | 11327 | 11379 | Housekeeping Gene | ARL1 |
| 3342 | CUST_P10079712 | 3205 | 3264 | Housekeeping Gene | ARL1 |
| 3343 | CUST_P10079740 | 10708 | 10767 | Housekeeping Gene | ARL1 |
| 3344 | CUST_P10079710 | 2561 | 2620 | Housekeeping Gene | ARL1 |
| 3345 | CUST_P10079717 | 3630 | 3689 | Housekeeping Gene | ARL1 |
| 3346 | CUST_P10079761 | 13619 | 13672 | Housekeeping Gene | ARL1 |
| 3347 | CUST_P10079707 | 1616 | 1675 | Housekeeping Gene | ARL1 |
| 3348 | CUST_P10079767 | 14091 | 14135 | Housekeeping Gene | ARL1 |
| 3349 | CUST_P10079699 | 861 | 910 | Housekeeping Gene | ARL1 |
| 3350 | CUST_P10079697 | 794 | 838 | Housekeeping Gene | ARL1 |
| 3351 | CUST_P10079694 | 683 | 742 | Housekeeping Gene | ARL1 |
| 3352 | CUST_P10079749 | 11842 | 11901 | Housekeeping Gene | ARL1 |
| 3353 | CUST_P10079716 | 3606 | 3665 | Housekeeping Gene | ARL1 |
| 3354 | CUST_P10079708 | 2224 | 2283 | Housekeeping Gene | ARL1 |
| 3355 | CUST_P10079719 | 4420 | 4479 | Housekeeping Gene | ARL1 |
| 3356 | CUST_P10079763 | 13695 | 13749 | Housekeeping Gene | ARL1 |
| 3357 | CUST_P10079752 | 12271 | 12330 | Housekeeping Gene | ARL1 |
| 3358 | CUST_P10079721 | 4794 | 4853 | Housekeeping Gene | ARL1 |
| 3359 | CUST_P10079766 | 14055 | 14099 | Housekeeping Gene | ARL1 |
| 3360 | CUST_P10079764 | 13860 | 13919 | Housekeeping Gene | ARL1 |
| 3361 | CUST_P10079765 | 13910 | 13963 | Housekeeping Gene | ARL1 |
| 3362 | CUST_P10079706 | 1514 | 1573 | Housekeeping Gene | ARL1 |
| 3363 | CUST_P10079705 | 1462 | 1509 | Housekeeping Gene | ARL1 |

TABLE 10-continued

Exemplary control probes

| SEQ ID NO: | ProbeID | Start | End | Type | Genomic Region |
|---|---|---|---|---|---|
| 3364 | CUST_P10079695 | 715 | 774 | Housekeeping Gene | ARL1 |
| 3365 | CUST_P10079698 | 836 | 884 | Housekeeping Gene | ARL1 |
| 3366 | CUST_P10079693 | 655 | 710 | Housekeeping Gene | ARL1 |
| 3367 | CUST_P10079754 | 12585 | 12644 | Housekeeping Gene | ARL1 |
| 3368 | CUST_P10079731 | 7083 | 7139 | Housekeeping Gene | ARL1 |
| 3369 | CUST_P10079723 | 5093 | 5152 | Housekeeping Gene | ARL1 |
| 3370 | CUST_P10079704 | 1198 | 1257 | Housekeeping Gene | ARL1 |
| 3371 | CUST_P10079756 | 12839 | 12888 | Housekeeping Gene | ARL1 |
| 3372 | CUST_P10079711 | 2977 | 3036 | Housekeeping Gene | ARL1 |
| 3373 | CUST_P10079709 | 2313 | 2369 | Housekeeping Gene | ARL1 |
| 3374 | CUST_P10079770 | 14253 | 14312 | Housekeeping Gene | ARL1 |
| 3375 | CUST_P10079700 | 891 | 939 | Housekeeping Gene | ARL1 |
| 3376 | CUST_P10079734 | 7994 | 8053 | Housekeeping Gene | ARL1 |
| 3377 | CUST_P10079729 | 6688 | 6746 | Housekeeping Gene | ARL1 |
| 3378 | CUST_P10079718 | 4205 | 4249 | Housekeeping Gene | ARL1 |
| 3379 | CUST_P10079751 | 12179 | 12229 | Housekeeping Gene | ARL1 |
| 3380 | CUST_P10079720 | 4653 | 4712 | Housekeeping Gene | ARL1 |
| 3381 | CUST_P10079725 | 5683 | 5733 | Housekeeping Gene | ARL1 |
| 3382 | CUST_P10079769 | 14139 | 14193 | Housekeeping Gene | ARL1 |
| 3383 | CUST_P10079771 | 14283 | 14342 | Housekeeping Gene | ARL1 |
| 3384 | CUST_P10079737 | 8984 | 9043 | Housekeeping Gene | ARL1 |
| 3385 | CUST_P10079757 | 12965 | 13024 | Housekeeping Gene | ARL1 |
| 3386 | CUST_P10079772 | 69 | 113 | Housekeeping Gene | CCDN1 |
| 3387 | CUST_P10079773 | 104 | 148 | Housekeeping Gene | CCDN1 |
| 3388 | CUST_P10079774 | 297 | 341 | Housekeeping Gene | CCDN1 |
| 3389 | CUST_P10079775 | 332 | 376 | Housekeeping Gene | CCDN1 |
| 3390 | CUST_P10079776 | 395 | 439 | Housekeeping Gene | CCDN1 |
| 3391 | CUST_P10079777 | 680 | 724 | Housekeeping Gene | CCDN1 |
| 3392 | CUST_P10079778 | 844 | 903 | Housekeeping Gene | CCDN1 |
| 3393 | CUST_P10079779 | 1049 | 1093 | Housekeeping Gene | CCDN1 |
| 3394 | CUST_P10079780 | 1146 | 1190 | Housekeeping Gene | CCDN1 |
| 3395 | CUST_P10079781 | 1368 | 1412 | Housekeeping Gene | CCDN1 |
| 3396 | CUST_P10079782 | 1513 | 1557 | Housekeeping Gene | CCDN1 |
| 3397 | CUST_P10079783 | 1553 | 1597 | Housekeeping Gene | CCDN1 |
| 3398 | CUST_P10079784 | 1811 | 1855 | Housekeeping Gene | CCDN1 |
| 3399 | CUST_P10079785 | 1936 | 1980 | Housekeeping Gene | CCDN1 |
| 3400 | CUST_P10079786 | 2041 | 2085 | Housekeeping Gene | CCDN1 |
| 3401 | CUST_P10079787 | 2206 | 2250 | Housekeeping Gene | CCDN1 |
| 3402 | CUST_P10079788 | 2233 | 2277 | Housekeeping Gene | CCDN1 |
| 3403 | CUST_P10079789 | 2279 | 2323 | Housekeeping Gene | CCDN1 |
| 3404 | CUST_P10079790 | 2321 | 2365 | Housekeeping Gene | CCDN1 |
| 3405 | CUST_P10079791 | 2346 | 2390 | Housekeeping Gene | CCDN1 |
| 3406 | CUST_P10079792 | 2376 | 2420 | Housekeeping Gene | CCDN1 |
| 3407 | CUST_P10079793 | 2385 | 2429 | Housekeeping Gene | CCDN1 |
| 3408 | CUST_P10079794 | 2413 | 2457 | Housekeeping Gene | CCDN1 |
| 3409 | CUST_P10079795 | 2455 | 2499 | Housekeeping Gene | CCDN1 |
| 3410 | CUST_P10079796 | 2584 | 2628 | Housekeeping Gene | CCDN1 |
| 3411 | CUST_P10079797 | 2794 | 2838 | Housekeeping Gene | CCDN1 |
| 3412 | CUST_P10079798 | 2842 | 2886 | Housekeeping Gene | CCDN1 |
| 3413 | CUST_P10079799 | 2899 | 2943 | Housekeeping Gene | CCDN1 |
| 3414 | CUST_P10079800 | 2953 | 2997 | Housekeeping Gene | CCDN1 |
| 3415 | CUST_P10079801 | 3037 | 3081 | Housekeeping Gene | CCDN1 |
| 3416 | CUST_P10079802 | 3135 | 3179 | Housekeeping Gene | CCDN1 |
| 3417 | CUST_P10079803 | 3194 | 3238 | Housekeeping Gene | CCDN1 |
| 3418 | CUST_P10079804 | 3365 | 3409 | Housekeeping Gene | CCDN1 |
| 3419 | CUST_P10079805 | 3518 | 3562 | Housekeeping Gene | CCDN1 |
| 3420 | CUST_P10079806 | 3675 | 3719 | Housekeeping Gene | CCDN1 |
| 3421 | CUST_P10079807 | 3753 | 3797 | Housekeeping Gene | CCDN1 |
| 3422 | CUST_P10079808 | 3904 | 3948 | Housekeeping Gene | CCDN1 |
| 3423 | CUST_P10079809 | 4120 | 4164 | Housekeeping Gene | CCDN1 |
| 3424 | CUST_P10079810 | 4201 | 4245 | Housekeeping Gene | CCDN1 |
| 3425 | CUST_P10079811 | 4312 | 4356 | Housekeeping Gene | CCDN1 |
| 3426 | CUST_P10079812 | 4419 | 4463 | Housekeeping Gene | CCDN1 |
| 3427 | CUST_P10079813 | 4486 | 4530 | Housekeeping Gene | CCDN1 |
| 3428 | CUST_P10079814 | 4518 | 4562 | Housekeeping Gene | CCDN1 |
| 3429 | CUST_P10079815 | 4542 | 4586 | Housekeeping Gene | CCDN1 |
| 3430 | CUST_P10079816 | 4560 | 4609 | Housekeeping Gene | CCDN1 |
| 3431 | CUST_P10079817 | 4595 | 4639 | Housekeeping Gene | CCDN1 |
| 3432 | CUST_P10079818 | 4633 | 4677 | Housekeeping Gene | CCDN1 |
| 3433 | CUST_P10079819 | 4645 | 4692 | Housekeeping Gene | CCDN1 |
| 3434 | CUST_P10079820 | 4674 | 4720 | Housekeeping Gene | CCDN1 |
| 3435 | CUST_P10079821 | 4726 | 4770 | Housekeeping Gene | CCDN1 |
| 3436 | CUST_P10079822 | 4753 | 4797 | Housekeeping Gene | CCDN1 |
| 3437 | CUST_P10079823 | 4910 | 4956 | Housekeeping Gene | CCDN1 |
| 3438 | CUST_P10079824 | 5081 | 5131 | Housekeeping Gene | CCDN1 |

TABLE 10-continued

Exemplary control probes

| SEQ ID NO: | ProbeID | Start | End | Type | Genomic Region |
|---|---|---|---|---|---|
| 3439 | CUST_P10079825 | 5281 | 5325 | Housekeeping Gene | CCDN1 |
| 3440 | CUST_P10079826 | 5295 | 5345 | Housekeeping Gene | CCDN1 |
| 3441 | CUST_P10079827 | 5319 | 5363 | Housekeeping Gene | CCDN1 |
| 3442 | CUST_P10079828 | 5472 | 5516 | Housekeeping Gene | CCDN1 |
| 3443 | CUST_P10079829 | 5506 | 5550 | Housekeeping Gene | CCDN1 |
| 3444 | CUST_P10079830 | 5654 | 5698 | Housekeeping Gene | CCDN1 |
| 3445 | CUST_P10079831 | 5680 | 5724 | Housekeeping Gene | CCDN1 |
| 3446 | CUST_P10079832 | 5709 | 5753 | Housekeeping Gene | CCDN1 |
| 3447 | CUST_P10079833 | 5736 | 5780 | Housekeeping Gene | CCDN1 |
| 3448 | CUST_P10079834 | 5775 | 5819 | Housekeeping Gene | CCDN1 |
| 3449 | CUST_P10079835 | 5804 | 5848 | Housekeeping Gene | CCDN1 |
| 3450 | CUST_P10079836 | 5828 | 5872 | Housekeeping Gene | CCDN1 |
| 3451 | CUST_P10079837 | 5876 | 5920 | Housekeeping Gene | CCDN1 |
| 3452 | CUST_P10079838 | 6010 | 6054 | Housekeeping Gene | CCDN1 |
| 3453 | CUST_P10079839 | 6083 | 6133 | Housekeeping Gene | CCDN1 |
| 3454 | CUST_P10079840 | 6163 | 6207 | Housekeeping Gene | CCDN1 |
| 3455 | CUST_P10079841 | 6270 | 6314 | Housekeeping Gene | CCDN1 |
| 3456 | CUST_P10079842 | 6395 | 6442 | Housekeeping Gene | CCDN1 |
| 3457 | CUST_P10079843 | 6557 | 6604 | Housekeeping Gene | CCDN1 |
| 3458 | CUST_P10079844 | 6611 | 6656 | Housekeeping Gene | CCDN1 |
| 3459 | CUST_P10079845 | 6635 | 6679 | Housekeeping Gene | CCDN1 |
| 3460 | CUST_P10079846 | 6770 | 6814 | Housekeeping Gene | CCDN1 |
| 3461 | CUST_P10079847 | 6895 | 6939 | Housekeeping Gene | CCDN1 |
| 3462 | CUST_P10079848 | 6976 | 7020 | Housekeeping Gene | CCDN1 |
| 3463 | CUST_P10079849 | 7012 | 7056 | Housekeeping Gene | CCDN1 |
| 3464 | CUST_P10079850 | 7064 | 7108 | Housekeeping Gene | CCDN1 |
| 3465 | CUST_P10079851 | 7224 | 7268 | Housekeeping Gene | CCDN1 |
| 3466 | CUST_P10079852 | 7283 | 7327 | Housekeeping Gene | CCDN1 |
| 3467 | CUST_P10079853 | 7444 | 7488 | Housekeeping Gene | CCDN1 |
| 3468 | CUST_P10079854 | 7649 | 7693 | Housekeeping Gene | CCDN1 |
| 3469 | CUST_P10079855 | 7768 | 7812 | Housekeeping Gene | CCDN1 |
| 3470 | CUST_P10079856 | 7794 | 7838 | Housekeeping Gene | CCDN1 |
| 3471 | CUST_P10079857 | 7858 | 7902 | Housekeeping Gene | CCDN1 |
| 3472 | CUST_P10079858 | 7957 | 8001 | Housekeeping Gene | CCDN1 |
| 3473 | CUST_P10079859 | 8092 | 8136 | Housekeeping Gene | CCDN1 |
| 3474 | CUST_P10079860 | 8120 | 8168 | Housekeeping Gene | CCDN1 |
| 3475 | CUST_P10079861 | 8173 | 8217 | Housekeeping Gene | CCDN1 |
| 3476 | CUST_P10079862 | 8228 | 8272 | Housekeeping Gene | CCDN1 |
| 3477 | CUST_P10079863 | 8422 | 8473 | Housekeeping Gene | CCDN1 |
| 3478 | CUST_P10079864 | 8469 | 8513 | Housekeeping Gene | CCDN1 |
| 3479 | CUST_P10079865 | 8649 | 8693 | Housekeeping Gene | CCDN1 |
| 3480 | CUST_P10079866 | 8842 | 8887 | Housekeeping Gene | CCDN1 |
| 3481 | CUST_P10079867 | 8960 | 9004 | Housekeeping Gene | CCDN1 |
| 3482 | CUST_P10079868 | 8995 | 9039 | Housekeeping Gene | CCDN1 |
| 3483 | CUST_P10079869 | 9060 | 9104 | Housekeeping Gene | CCDN1 |
| 3484 | CUST_P10079870 | 9132 | 9176 | Housekeeping Gene | CCDN1 |
| 3485 | CUST_P10079871 | 9183 | 9227 | Housekeeping Gene | CCDN1 |
| 3486 | CUST_P10079872 | 9196 | 9240 | Housekeeping Gene | CCDN1 |
| 3487 | CUST_P10079873 | 9229 | 9273 | Housekeeping Gene | CCDN1 |
| 3488 | CUST_P10079874 | 9266 | 9310 | Housekeeping Gene | CCDN1 |
| 3489 | CUST_P10079875 | 9309 | 9353 | Housekeeping Gene | CCDN1 |
| 3490 | CUST_P10079876 | 9333 | 9377 | Housekeeping Gene | CCDN1 |
| 3491 | CUST_P10079877 | 9390 | 9434 | Housekeeping Gene | CCDN1 |
| 3492 | CUST_P10079878 | 9430 | 9474 | Housekeeping Gene | CCDN1 |
| 3493 | CUST_P10079879 | 9479 | 9523 | Housekeeping Gene | CCDN1 |
| 3494 | CUST_P10079880 | 9508 | 9552 | Housekeeping Gene | CCDN1 |
| 3495 | CUST_P10079881 | 9519 | 9563 | Housekeeping Gene | CCDN1 |
| 3496 | CUST_P10079882 | 9570 | 9614 | Housekeeping Gene | CCDN1 |
| 3497 | CUST_P10079883 | 9592 | 9639 | Housekeeping Gene | CCDN1 |
| 3498 | CUST_P10079884 | 9705 | 9749 | Housekeeping Gene | CCDN1 |
| 3499 | CUST_P10079885 | 9885 | 9933 | Housekeeping Gene | CCDN1 |
| 3500 | CUST_P10079886 | 10029 | 10073 | Housekeeping Gene | CCDN1 |
| 3501 | CUST_P10079887 | 10165 | 10209 | Housekeeping Gene | CCDN1 |
| 3502 | CUST_P10079888 | 10204 | 10248 | Housekeeping Gene | CCDN1 |
| 3503 | CUST_P10079889 | 10442 | 10501 | Housekeeping Gene | CCDN1 |
| 3504 | CUST_P10079890 | 10526 | 10574 | Housekeeping Gene | CCDN1 |
| 3505 | CUST_P10079891 | 10760 | 10819 | Housekeeping Gene | CCDN1 |
| 3506 | CUST_P10079892 | 10833 | 10877 | Housekeeping Gene | CCDN1 |
| 3507 | CUST_P10079893 | 10868 | 10912 | Housekeeping Gene | CCDN1 |
| 3508 | CUST_P10079894 | 10900 | 10944 | Housekeeping Gene | CCDN1 |
| 3509 | CUST_P10079895 | 10931 | 10975 | Housekeeping Gene | CCDN1 |
| 3510 | CUST_P10079896 | 11055 | 11107 | Housekeeping Gene | CCDN1 |
| 3511 | CUST_P10079897 | 11190 | 11242 | Housekeeping Gene | CCDN1 |
| 3512 | CUST_P10079898 | 11364 | 11410 | Housekeeping Gene | CCDN1 |
| 3513 | CUST_P10079899 | 11472 | 11525 | Housekeeping Gene | CCDN1 |

TABLE 10-continued

Exemplary control probes

| SEQ ID NO: | ProbeID | Start | End | Type | Genomic Region |
|---|---|---|---|---|---|
| 3514 | CUST_P10079900 | 11490 | 11547 | Housekeeping Gene | CCDN1 |
| 3515 | CUST_P10079901 | 11807 | 11852 | Housekeeping Gene | CCDN1 |
| 3516 | CUST_P10079902 | 11887 | 11940 | Housekeeping Gene | CCDN1 |
| 3517 | CUST_P10079903 | 12162 | 12221 | Housekeeping Gene | CCDN1 |
| 3518 | CUST_P10079904 | 12355 | 12412 | Housekeeping Gene | CCDN1 |
| 3519 | CUST_P10079905 | 12402 | 12446 | Housekeeping Gene | CCDN1 |
| 3520 | CUST_P10081361 | 16 | 63 | Negative Control | *Aedes albopictus densovirus 2* |
| 3521 | CUST_P10081362 | 47 | 101 | Negative Control | *Aedes albopictus densovirus 2* |
| 3522 | CUST_P10081363 | 79 | 131 | Negative Control | *Aedes albopictus densovirus 2* |
| 3523 | CUST_P10081364 | 204 | 248 | Negative Control | *Aedes albopictus densovirus 2* |
| 3524 | CUST_P10081365 | 302 | 361 | Negative Control | *Aedes albopictus densovirus 2* |
| 3525 | CUST_P10081366 | 330 | 385 | Negative Control | *Aedes albopictus densovirus 2* |
| 3526 | CUST_P10081367 | 390 | 435 | Negative Control | *Aedes albopictus densovirus 2* |
| 3527 | CUST_P10081368 | 426 | 472 | Negative Control | *Aedes albopictus densovirus 2* |
| 3528 | CUST_P10081369 | 590 | 649 | Negative Control | *Aedes albopictus densovirus 2* |
| 3529 | CUST_P10081370 | 617 | 673 | Negative Control | *Aedes albopictus densovirus 2* |
| 3530 | CUST_P10081371 | 654 | 707 | Negative Control | *Aedes albopictus densovirus 2* |
| 3531 | CUST_P10081372 | 753 | 810 | Negative Control | *Aedes albopictus densovirus 2* |
| 3532 | CUST_P10081373 | 791 | 844 | Negative Control | *Aedes albopictus densovirus 2* |
| 3533 | CUST_P10081374 | 824 | 880 | Negative Control | *Aedes albopictus densovirus 2* |
| 3534 | CUST_P10081375 | 966 | 1015 | Negative Control | *Aedes albopictus densovirus 2* |
| 3535 | CUST_P10081376 | 1174 | 1233 | Negative Control | *Aedes albopictus densovirus 2* |
| 3536 | CUST_P10081377 | 1295 | 1339 | Negative Control | *Aedes albopictus densovirus 2* |
| 3537 | CUST_P10081378 | 1385 | 1433 | Negative Control | *Aedes albopictus densovirus 2* |
| 3538 | CUST_P10081379 | 1538 | 1582 | Negative Control | *Aedes albopictus densovirus 2* |
| 3539 | CUST_P10081380 | 1556 | 1601 | Negative Control | *Aedes albopictus densovirus 2* |
| 3540 | CUST_P10081381 | 1636 | 1689 | Negative Control | *Aedes albopictus densovirus 2* |
| 3541 | CUST_P10081382 | 1752 | 1811 | Negative Control | *Aedes albopictus densovirus 2* |
| 3542 | CUST_P10081383 | 1810 | 1854 | Negative Control | *Aedes albopictus densovirus 2* |
| 3543 | CUST_P10081384 | 1836 | 1893 | Negative Control | *Aedes albopictus densovirus 2* |
| 3544 | CUST_P10081385 | 1858 | 1913 | Negative Control | *Aedes albopictus densovirus 2* |
| 3545 | CUST_P10081386 | 1977 | 2036 | Negative Control | *Aedes albopictus densovirus 2* |
| 3546 | CUST_P10081387 | 2065 | 2124 | Negative Control | *Aedes albopictus densovirus 2* |
| 3547 | CUST_P10081388 | 2093 | 2152 | Negative Control | *Aedes albopictus densovirus 2* |
| 3548 | CUST_P10081389 | 2136 | 2195 | Negative Control | *Aedes albopictus densovirus 2* |
| 3549 | CUST_P10081390 | 2162 | 2221 | Negative Control | *Aedes albopictus densovirus 2* |
| 3550 | CUST_P10081391 | 2209 | 2257 | Negative Control | *Aedes albopictus densovirus 2* |
| 3551 | CUST_P10081392 | 2384 | 2434 | Negative Control | *Aedes albopictus densovirus 2* |
| 3552 | CUST_P10081393 | 2497 | 2546 | Negative Control | *Aedes albopictus densovirus 2* |
| 3553 | CUST_P10081394 | 2530 | 2589 | Negative Control | *Aedes albopictus densovirus 3* |

TABLE 10-continued

Exemplary control probes

| SEQ ID NO: | ProbeID | Start | End | Type | Genomic Region |
|---|---|---|---|---|---|
| 3554 | CUST_P10081395 | 2697 | 2754 | Negative Control | Aedes albopictus densovirus 2 |
| 3555 | CUST_P10081396 | 2766 | 2825 | Negative Control | Aedes albopictus densovirus 2 |
| 3556 | CUST_P10081397 | 281 | 340 | Negative Control | Aedes albopictus densovirus 2 |
| 3557 | CUST_P10081398 | 353 | 404 | Negative Control | Aedes albopictus densovirus 2 |
| 3558 | CUST_P10081399 | 411 | 457 | Negative Control | Maize streak virus |
| 3559 | CUST_P10081400 | 572 | 630 | Negative Control | Maize streak virus |
| 3560 | CUST_P10081401 | 727 | 786 | Negative Control | Maize streak virus |
| 3561 | CUST_P10081402 | 760 | 819 | Negative Control | Maize streak virus |
| 3562 | CUST_P10081403 | 799 | 852 | Negative Control | Maize streak virus |
| 3563 | CUST_P10081404 | 839 | 891 | Negative Control | Maize streak virus |
| 3564 | CUST_P10081405 | 871 | 919 | Negative Control | Maize streak virus |
| 3565 | CUST_P10081406 | 937 | 988 | Negative Control | Maize streak virus |
| 3566 | CUST_P10081407 | 961 | 1011 | Negative Control | Maize streak virus |
| 3567 | CUST_P10081408 | 1177 | 1233 | Negative Control | Maize streak virus |
| 3568 | CUST_P10081409 | 1316 | 1365 | Negative Control | Maize streak virus |
| 3569 | CUST_P10081410 | 1362 | 1420 | Negative Control | Maize streak virus |
| 3570 | CUST_P10081411 | 1391 | 1450 | Negative Control | Maize streak virus |
| 3571 | CUST_P10081412 | 1447 | 1506 | Negative Control | Maize streak virus |
| 3572 | CUST_P10081413 | 1694 | 1753 | Negative Control | Maize streak virus |
| 3573 | CUST_P10081414 | 1837 | 1896 | Negative Control | Maize streak virus |
| 3574 | CUST_P10081415 | 2047 | 2106 | Negative Control | Maize streak virus |
| 3575 | CUST_P10081416 | 2095 | 2147 | Negative Control | Maize streak virus |
| 3576 | CUST_P10081417 | 2362 | 2421 | Negative Control | Maize streak virus |
| 3577 | CUST_P10081418 | 2387 | 2446 | Negative Control | Maize streak virus |
| 3578 | CUST_P10081419 | 2536 | 2595 | Negative Control | Maize streak virus |
| 3579 | CUST_P10081420 | 2666 | 2713 | Negative Control | Maize streak virus |
| 3580 | CUST_P10081421 | 2893 | 2952 | Negative Control | Maize streak virus |
| 3581 | CUST_P10081422 | 2953 | 3012 | Negative Control | Maize streak virus |
| 3582 | CUST_P10081423 | 2987 | 3045 | Negative Control | Maize streak virus |
| 3583 | CUST_P10081424 | 3014 | 3071 | Negative Control | Maize streak virus |
| 3584 | CUST_P10081425 | 3054 | 3105 | Negative Control | Maize streak virus |
| 3585 | CUST_P10081426 | 3093 | 3142 | Negative Control | Maize streak virus |
| 3586 | CUST_P10081427 | 3144 | 3203 | Negative Control | Maize streak virus |
| 3587 | CUST_P10081428 | 3194 | 3253 | Negative Control | Maize streak virus |
| 3588 | CUST_P10081429 | 3330 | 3389 | Negative Control | Maize streak virus |
| 3589 | CUST_P10081430 | 3390 | 3438 | Negative Control | Maize streak virus |
| 3590 | CUST_P10081431 | 3414 | 3469 | Negative Control | Maize streak virus |
| 3591 | CUST_P10081432 | 3441 | 3494 | Negative Control | Maize streak virus |
| 3592 | CUST_P10081433 | 3525 | 3584 | Negative Control | Maize streak virus |
| 3593 | CUST_P10081434 | 3586 | 3645 | Negative Control | Maize streak virus |
| 3594 | CUST_P10081435 | 3727 | 3786 | Negative Control | Maize streak virus |
| 3595 | CUST_P10081436 | 3879 | 3923 | Negative Control | Maize streak virus |
| 3596 | CUST_P10081437 | 3967 | 4011 | Negative Control | Maize streak virus |
| 3597 | CUST_P10081438 | 112 | 169 | Negative Control | Maize streak virus |
| 3598 | CUST_P10081439 | 272 | 316 | Negative Control | Maize streak virus |
| 3599 | CUST_P10081440 | 301 | 345 | Negative Control | Tomato pseudo-curly top virus |
| 3600 | CUST_P10081441 | 341 | 387 | Negative Control | Tomato pseudo-curly top virus |
| 3601 | CUST_P10081442 | 436 | 480 | Negative Control | Tomato pseudo-curly top virus |
| 3602 | CUST_P10081443 | 468 | 515 | Negative Control | Tomato pseudo-curly top virus |
| 3603 | CUST_P10081444 | 490 | 534 | Negative Control | Tomato pseudo-curly top virus |
| 3604 | CUST_P10081446 | 687 | 731 | Negative Control | Tomato pseudo-curly top virus |
| 3605 | CUST_P10081447 | 803 | 847 | Negative Control | Tomato pseudo-curly top virus |
| 3606 | CUST_P10081448 | 813 | 857 | Negative Control | Tomato pseudo-curly top virus |
| 3607 | CUST_P10081449 | 842 | 887 | Negative Control | Tomato pseudo-curly top virus |
| 3608 | CUST_P10081451 | 1031 | 1090 | Negative Control | Tomato pseudo-curly top virus |
| 3609 | CUST_P10081452 | 1120 | 1164 | Negative Control | Tomato pseudo-curly top virus |

TABLE 10-continued

Exemplary control probes

| SEQ ID NO: | ProbeID | Start | End | Type | Genomic Region |
|---|---|---|---|---|---|
| 3610 | CUST_P10081453 | 1166 | 1214 | Negative Control | Tomato pseudo-curly top virus |
| 3611 | CUST_P10081454 | 1187 | 1246 | Negative Control | Tomato pseudo-curly top virus |
| 3612 | CUST_P10081455 | 1216 | 1260 | Negative Control | Tomato pseudo-curly top virus |
| 3613 | CUST_P10081456 | 1332 | 1385 | Negative Control | Tomato pseudo-curly top virus |
| 3614 | CUST_P10081457 | 1370 | 1429 | Negative Control | Tomato pseudo-curly top virus |
| 3615 | CUST_P10081458 | 1407 | 1459 | Negative Control | Tomato pseudo-curly top virus |
| 3616 | CUST_P10081459 | 1440 | 1499 | Negative Control | Tomato pseudo-curly top virus |
| 3617 | CUST_P10081460 | 1600 | 1650 | Negative Control | Tomato pseudo-curly top virus |
| 3618 | CUST_P10081461 | 1615 | 1669 | Negative Control | Tomato pseudo-curly top virus |
| 3619 | CUST_P10081462 | 1648 | 1698 | Negative Control | Tomato pseudo-curly top virus |
| 3620 | CUST_P10081463 | 1740 | 1797 | Negative Control | Tomato pseudo-curly top virus |
| 3621 | CUST_P10081464 | 2072 | 2128 | Negative Control | Tomato pseudo-curly top virus |
| 3622 | CUST_P10081465 | 2114 | 2173 | Negative Control | Tomato pseudo-curly top virus |
| 3623 | CUST_P10081466 | 2158 | 2217 | Negative Control | Tomato pseudo-curly top virus |
| 3624 | CUST_P10081467 | 2296 | 2346 | Negative Control | Tomato pseudo-curly top virus |
| 3625 | CUST_P10081468 | 2446 | 2490 | Negative Control | Tomato pseudo-curly top virus |
| 3626 | CUST_P10081470 | 2548 | 2592 | Negative Control | Tomato pseudo-curly top virus |
| 3627 | CUST_P10081471 | 2596 | 2650 | Negative Control | Tomato pseudo-curly top virus |
| 3628 | CUST_P10081472 | 2633 | 2683 | Negative Control | Tomato pseudo-curly top virus |

In view of the many possible embodiments to which the principles of the disclosure may be applied, it should be recognized that the illustrated embodiments are only examples and should not be taken as limiting the scope of the invention. Rather, the scope of the invention is defined by the following claims. We therefore claim as our invention all that comes within the scope and spirit of these claims.

SEQUENCE LISTING (3628 sequences)

SEQ ID NO: 1 - DNA, 60 bp, Artificial Sequence
  Synthetic oligonucleotide probe
aagactgctagccgagtagtgttgggtcgcgaaaggccttgtggtactgcctgatagggt

SEQ ID NO: 2 - DNA, 60 bp, Artificial Sequence
  Synthetic oligonucleotide probe
tttcttggataaacccgctcaatgcctggagatttgggcgtgcccccgcaagactgctag

SEQ ID NO: 3 - DNA, 60 bp, Artificial Sequence
  Synthetic oligonucleotide probe
ctttcttggataaacccgctcaatgcctggagatttgggcgtgcccccgcaagactgcta

SEQ ID NO: 4 - DNA, 60 bp, Artificial Sequence
  Synthetic oligonucleotide probe
attgccaggacgaccgggtcctttcttggataaacccgctcaatgcctggagatttgggc

SEQ ID NO: 5 - DNA, 60 bp, Artificial Sequence
  Synthetic oligonucleotide probe
aattgccaggacgaccgggtcctttcttggataaacccgctcaatgcctggagatttggg

SEQ ID NO: 6 - DNA, 60 bp, Artificial Sequence
  Synthetic oligonucleotide probe
gaattgccaggacgaccgggtcctttcttggataaacccgctcaatgcctggagatttgg

SEQ ID NO: 7 - DNA, 60 bp, Artificial Sequence
  Synthetic oligonucleotide probe
ggaattgccaggacgaccgggtcctttcttggataaacccgctcaatgcctggagatttg

SEQ ID NO: 8 - DNA, 60 bp, Artificial Sequence
  Synthetic oligonucleotide probe
cggaattgccaggacgaccgggtcctttcttggataaacccgctcaatgcctggagattt

SEQ ID NO: 9 - DNA, 60 bp, Artificial Sequence
  Synthetic oligonucleotide probe
ccggaattgccaggacgaccgggtcctttcttggataaacccgctcaatgcctggagatt

SEQ ID NO: 10 - DNA, 60 bp, Artificial Sequence
  Synthetic oligonucleotide probe
accggaattgccaggacgaccgggtcctttcttggataaacccgctcaatgcctggagat

SEQ ID NO: 11 - DNA, 60 bp, Artificial Sequence
  Synthetic oligonucleotide probe
actatgcaacagggaaccttcctggttgctctttctctatcttccttctggccctgctct

SEQ ID NO: 12 - DNA, 60 bp, Artificial Sequence
  Synthetic oligonucleotide probe
aactatgcaacagggaaccttcctggttgctctttctctatcttccttctggccctgctc

SEQ ID NO: 13 - DNA, 60 bp, Artificial Sequence
  Synthetic oligonucleotide probe
gaactatgcaacagggaaccttcctggttgctctttctctatcttccttctggccctgct

SEQ ID NO: 14 - DNA, 60 bp, Artificial Sequence
  Synthetic oligonucleotide probe
tgaactatgcaacagggaaccttcctggttgctctttctctatcttccttctggccctgc

SEQ ID NO: 15 - DNA, 60 bp, Artificial Sequence
  Synthetic oligonucleotide probe
gtgaactatgcaacagggaaccttcctggttgctctttctctatcttccttctggccctg

SEQ ID NO: 16 - DNA, 60 bp, Artificial Sequence
  Synthetic oligonucleotide probe
cgtgaactatgcaacagggaaccttcctggttgctctttctctatcttccttctggccct

SEQ ID NO: 17 - DNA, 60 bp, Artificial Sequence
  Synthetic oligonucleotide probe
gcgtgaactatgcaacagggaaccttcctggttgctctttctctatcttccttctggccc

SEQ ID NO: 18 - DNA, 60 bp, Artificial Sequence
  Synthetic oligonucleotide probe
ggcgtgaactatgcaacagggaaccttcctggttgctctttctctatcttccttctggcc

SEQ ID NO: 19 - DNA, 60 bp, Artificial Sequence
  Synthetic oligonucleotide probe
cggcgtgaactatgcaacagggaaccttcctggttgctctttctctatcttccttctggc

SEQ ID NO: 20 - DNA, 60 bp, Artificial Sequence
  Synthetic oligonucleotide probe
acggcgtgaactatgcaacagggaaccttcctggttgctctttctctatcttccttctgg

SEQ ID NO: 21 - DNA, 60 bp, Artificial Sequence
  Synthetic oligonucleotide probe
ttgttctatctatcccggccatataacgggtcatcgcatggcatgggatatgatgatgaa

SEQ ID NO: 22 - DNA, 60 bp, Artificial Sequence
  Synthetic oligonucleotide probe
attgttctatctatcccggccatataacgggtcatcgcatggcatgggatatgatgatga

SEQ ID NO: 23 - DNA, 60 bp, Artificial Sequence
  Synthetic oligonucleotide probe
aattgttctatctatcccggccatataacgggtcatcgcatggcatgggatatgatgatg

SEQ ID NO: 24 - DNA, 60 bp, Artificial Sequence
  Synthetic oligonucleotide probe
caattgttctatctatcccggccatataacgggtcatcgcatggcatgggatatgatgat

SEQ ID NO: 25 - DNA, 60 bp, Artificial Sequence
  Synthetic oligonucleotide probe
agcgtatttctccatggtggggaactgggcgaaggtcctggtagtgctgctgctatttgc

SEQ ID NO: 26 - DNA, 60 bp, Artificial Sequence
  Synthetic oligonucleotide probe
tagcgtatttctccatggtggggaactgggcgaaggtcctggtagtgctgctgctatttg

SEQ ID NO: 27 - DNA, 60 bp, Artificial Sequence
  Synthetic oligonucleotide probe
atagcgtatttctccatggtggggaactgggcgaaggtcctggtagtgctgctgctattt

SEQ ID NO: 28 - DNA, 60 bp, Artificial Sequence
  Synthetic oligonucleotide probe
catagcgtatttctccatggtggggaactgggcgaaggtcctggtagtgctgctgctatt

SEQ ID NO: 29 - DNA, 60 bp, Artificial Sequence
  Synthetic oligonucleotide probe
gcatagcgtatttctccatggtggggaactgggcgaaggtcctggtagtgctgctgctat

SEQ ID NO: 30 - DNA, 60 bp, Artificial Sequence
  Synthetic oligonucleotide probe
atggcatgggatatgatgatgaactggtcccctacggcagcgttggtggtagctcagctg

SEQ ID NO: 31 - DNA, 60 bp, Artificial Sequence
  Synthetic oligonucleotide probe
tatccttgtaccatcaattacaccatattcaaagtcaggatgtacgtgggaggggtcgag

SEQ ID NO: 32 - DNA, 60 bp, Artificial Sequence
  Synthetic oligonucleotide probe
ctatccttgtaccatcaattacaccatattcaaagtcaggatgtacgtgggaggggtcga

SEQ ID NO: 33 - DNA, 60 bp, Artificial Sequence
  Synthetic oligonucleotide probe
actatccttgtaccatcaattacaccatattcaaagtcaggatgtacgtgggaggggtcg

SEQ ID NO: 34 - DNA, 60 bp, Artificial Sequence
  Synthetic oligonucleotide probe
cactatccttgtaccatcaattacaccatattcaaagtcaggatgtacgtgggaggggtc

SEQ ID NO: 35 - DNA, 60 bp, Artificial Sequence
  Synthetic oligonucleotide probe
gcactatccttgtaccatcaattacaccatattcaaagtcaggatgtacgtgggaggggt

SEQ ID NO: 36 - DNA, 60 bp, Artificial Sequence
  Synthetic oligonucleotide probe
tggcactatccttgtaccatcaattacaccatattcaaagtcaggatgtacgtgggaggg

SEQ ID NO: 37 - DNA, 60 bp, Artificial Sequence
  Synthetic oligonucleotide probe
ttggcactatccttgtaccatcaattacaccatattcaaagtcaggatgtacgtgggagg

SEQ ID NO: 38 - DNA, 60 bp, Artificial Sequence
  Synthetic oligonucleotide probe
tttggcactatccttgtaccatcaattacaccatattcaaagtcaggatgtacgtgggag

SEQ ID NO: 39 - DNA, 60 bp, Artificial Sequence
  Synthetic oligonucleotide probe
ctttggcactatccttgtaccatcaattacaccatattcaaagtcaggatgtacgtggga

SEQ ID NO: 40 - DNA, 60 bp, Artificial Sequence
  Synthetic oligonucleotide probe
gctttggcactatccttgtaccatcaattacaccatattcaaagtcaggatgtacgtggg

SEQ ID NO: 41 - DNA, 60 bp, Artificial Sequence
  Synthetic oligonucleotide probe
ttgtgtccttcctcgtgttcttctgctttgcgtggtatctgaagggtaggtgggtgcccg

SEQ ID NO: 42 - DNA, 60 bp, Artificial Sequence
  Synthetic oligonucleotide probe
cttgtgtccttcctcgtgttcttctgctttgcgtggtatctgaagggtaggtgggtgccc

SEQ ID NO: 43 - DNA, 60 bp, Artificial Sequence
  Synthetic oligonucleotide probe
tcttgtgtccttcctcgtgttcttctgctttgcgtggtatctgaagggtaggtgggtgcc

SEQ ID NO: 44 - DNA, 60 bp, Artificial Sequence
  Synthetic oligonucleotide probe
gtcttgtgtccttcctcgtgttcttctgctttgcgtggtatctgaagggtaggtgggtgc

SEQ ID NO: 45 - DNA, 60 bp, Artificial Sequence
  Synthetic oligonucleotide probe
ggtcttgtgtccttcctcgtgttcttctgctttgcgtggtatctgaagggtaggtgggtg

SEQ ID NO: 46 - DNA, 60 bp, Artificial Sequence
  Synthetic oligonucleotide probe
cggtcttgtgtccttcctcgtgttcttctgctttgcgtggtatctgaagggtaggtgggt

SEQ ID NO: 47 - DNA, 60 bp, Artificial Sequence
  Synthetic oligonucleotide probe
acggtcttgtgtccttcctcgtgttcttctgctttgcgtggtatctgaagggtaggtggg

SEQ ID NO: 48 - DNA, 60 bp, Artificial Sequence
  Synthetic oligonucleotide probe
cacggtcttgtgtccttcctcgtgttcttctgctttgcgtggtatctgaagggtaggtgg

SEQ ID NO: 49 - DNA, 60 bp, Artificial Sequence
  Synthetic oligonucleotide probe
gcacggtcttgtgtccttcctcgtgttcttctgctttgcgtggtatctgaagggtaggtg

SEQ ID NO: 50 - DNA, 60 bp, Artificial Sequence
  Synthetic oligonucleotide probe
cgcacggtcttgtgtccttcctcgtgttcttctgctttgcgtggtatctgaagggtaggt

SEQ ID NO: 51 - DNA, 60 bp, Artificial Sequence
  Synthetic oligonucleotide probe
tcattacgtgcaaatggccatcatcaagttaggggcgcttactggcacctatgtgtataa

SEQ ID NO: 52 - DNA, 60 bp, Artificial Sequence
  Synthetic oligonucleotide probe
tcttactcatgtgtgttgtacacccgactctggtatttgacatcaccaaactactcctgg

SEQ ID NO: 53 - DNA, 60 bp, Artificial Sequence
  Synthetic oligonucleotide probe
atcttactcatgtgtgttgtacacccgactctggtatttgacatcaccaaactactcctg

SEQ ID NO: 54 - DNA, 60 bp, Artificial Sequence
  Synthetic oligonucleotide probe
catcttactcatgtgtgttgtacacccgactctggtatttgacatcaccaaactactcct

SEQ ID NO: 55 - DNA, 60 bp, Artificial Sequence
  Synthetic oligonucleotide probe
tcatcttactcatgtgtgttgtacacccgactctggtatttgacatcaccaaactactcc

SEQ ID NO: 56 - DNA, 60 bp, Artificial Sequence
  Synthetic oligonucleotide probe
gtcatcttactcatgtgtgttgtacacccgactctggtatttgacatcaccaaactactc

SEQ ID NO: 57 - DNA, 60 bp, Artificial Sequence
  Synthetic oligonucleotide probe
cgtcatcttactcatgtgtgttgtacacccgactctggtatttgacatcaccaaactact

SEQ ID NO: 58 - DNA, 60 bp, Artificial Sequence
  Synthetic oligonucleotide probe
ccgtcatcttactcatgtgtgttgtacacccgactctggtatttgacatcaccaaactac

SEQ ID NO: 59 - DNA, 60 bp, Artificial Sequence
  Synthetic oligonucleotide probe
gccgtcatcttactcatgtgtgttgtacacccgactctggtatttgacatcaccaaacta

SEQ ID NO: 60 - DNA, 60 bp, Artificial Sequence
  Synthetic oligonucleotide probe
tgccgtcatcttactcatgtgtgttgtacacccgactctggtatttgacatcaccaaact

SEQ ID NO: 61 - DNA, 60 bp, Artificial Sequence
  Synthetic oligonucleotide probe
tgttcagaatgaagtcaccctgacgcacccaatcaccaaatacatcatgacatgcatgtc

SEQ ID NO: 62 - DNA, 60 bp, Artificial Sequence
  Synthetic oligonucleotide probe
tcatatagatgcccactttctatcccagacaaagcagagtggggagaactttccttacct

SEQ ID NO: 63 - DNA, 60 bp, Artificial Sequence
  Synthetic oligonucleotide probe
ttatgacataataatttgtgacgagtgccactccacggatgccacatccatcttgggcat

SEQ ID NO: 64 - DNA, 60 bp, Artificial Sequence
  Synthetic oligonucleotide probe
tggaagtgtttgatccgccttaaacccaccctccatgggccaacacccctgctatacaga

SEQ ID NO: 65 - DNA, 60 bp, Artificial Sequence
  Synthetic oligonucleotide probe
tgcttggtatgagctcacgcccgccgagactacagttaggctacgagcgtacatgaacac

SEQ ID NO: 66 - DNA, 60 bp, Artificial Sequence
  Synthetic oligonucleotide probe
gtcactcagacagtcgatttcagccttgaccctacctttaccattgagacaaccacgctc

SEQ ID NO: 67 - DNA, 60 bp, Artificial Sequence
  Synthetic oligonucleotide probe
gatgctctcatgactggctttaccggcgacttcgactctgtgatagactgcaacacgtgt

SEQ ID NO: 68 - DNA, 60 bp, Artificial Sequence
  Synthetic oligonucleotide probe
tctcatcttctgccactcaaagaagaagtgcgacgagctcgccgcgaagctggtcgcatt

SEQ ID NO: 69 - DNA, 60 bp, Artificial Sequence
  Synthetic oligonucleotide probe
tctgtccaccaccggagagatccctttttacggcaaggctatccccctcgaggtgatcaa

SEQ ID NO: 70 - DNA, 60 bp, Artificial Sequence
  Synthetic oligonucleotide probe
ggtgagaacaattaccactggcagccccatcacgtactccacctacggcaagttccttgc

SEQ ID NO: 71 - DNA, 60 bp, Artificial Sequence
  Synthetic oligonucleotide probe
ccggcaattatacctgacagggaggttctctaccaggagttcgatgagatggaagagtgc

SEQ ID NO: 72 - DNA, 60 bp, Artificial Sequence
  Synthetic oligonucleotide probe
gccggcaattatacctgacagggaggttctctaccaggagttcgatgagatggaagagtg

SEQ ID NO: 73 - DNA, 60 bp, Artificial Sequence
  Synthetic oligonucleotide probe
agccggcaattatacctgacagggaggttctctaccaggagttcgatgagatggaagagt

SEQ ID NO: 74 - DNA, 60 bp, Artificial Sequence
  Synthetic oligonucleotide probe
aagccggcaattatacctgacagggaggttctctaccaggagttcgatgagatggaagag

SEQ ID NO: 75 - DNA, 60 bp, Artificial Sequence
  Synthetic oligonucleotide probe
gaagccggcaattatacctgacagggaggttctctaccaggagttcgatgagatggaaga

SEQ ID NO: 76 - DNA, 60 bp, Artificial Sequence
  Synthetic oligonucleotide probe
ggaagccggcaattatacctgacagggaggttctctaccaggagttcgatgagatggaag

SEQ ID NO: 77 - DNA, 60 bp, Artificial Sequence
  Synthetic oligonucleotide probe
gggaagccggcaattatacctgacagggaggttctctaccaggagttcgatgagatggaa

SEQ ID NO: 78 - DNA, 60 bp, Artificial Sequence
  Synthetic oligonucleotide probe
cgggaagccggcaattatacctgacagggaggttctctaccaggagttcgatgagatgga

SEQ ID NO: 79 - DNA, 60 bp, Artificial Sequence
  Synthetic oligonucleotide probe
ccgggaagccggcaattatacctgacagggaggttctctaccaggagttcgatgagatgg

SEQ ID NO: 80 - DNA, 60 bp, Artificial Sequence
  Synthetic oligonucleotide probe
tccgggaagccggcaattatacctgacagggaggttctctaccaggagttcgatgagatg

SEQ ID NO: 81 - DNA, 60 bp, Artificial Sequence
  Synthetic oligonucleotide probe
aaactcgaggtcttctgggcgaagcacatgtggaatttcatcagtgggatacaatacttg

SEQ ID NO: 82 - DNA, 60 bp, Artificial Sequence
  Synthetic oligonucleotide probe
tgtaacccagctcctgaggcgactgcatcagtggataagctcggagtgtaccactccatg

SEQ ID NO: 83 - DNA, 60 bp, Artificial Sequence
  Synthetic oligonucleotide probe
tgccatactcagcagcctcactgtaacccagctcctgaggcgactgcatcagtggataag

SEQ ID NO: 84 - DNA, 60 bp, Artificial Sequence
  Synthetic oligonucleotide probe
tgtagcattcaagatcatgagcggtgaggtcccctccacggaggacctggtcaatctgct

SEQ ID NO: 85 - DNA, 60 bp, Artificial Sequence
  Synthetic oligonucleotide probe
acattcttgcagggtatggcgcgggcgtggcgggagctcttgtagcattcaagatcatga

SEQ ID NO: 86 - DNA, 60 bp, Artificial Sequence
  Synthetic oligonucleotide probe
attgcttcattgatggcttttacagctgccgtcaccagcccactaaccactggccaaacc

SEQ ID NO: 87 - DNA, 60 bp, Artificial Sequence
  Synthetic oligonucleotide probe
aacgctgcctggtaaccccgccattgcttcattgatggcttttacagctgccgtcaccag

SEQ ID NO: 88 - DNA, 60 bp, Artificial Sequence
  Synthetic oligonucleotide probe
tacaatacttggcgggcctgtcaacgctgcctggtaaccccgccattgcttcattgatgg

SEQ ID NO: 89 - DNA, 60 bp, Artificial Sequence
  Synthetic oligonucleotide probe
gtggaatttcatcagtgggatacaatacttggcgggcctgtcaacgctgcctggtaaccc

SEQ ID NO: 90 - DNA, 60 bp, Artificial Sequence
  Synthetic oligonucleotide probe
ctgtccagaccaactggcagaaactcgaggtcttctgggcgaagcacatgtggaatttca

SEQ ID NO: 91 - DNA, 60 bp, Artificial Sequence
  Synthetic oligonucleotide probe
tactgacaatcttaaatgcccgtgccagatcccatcgcccgaatttttcacagaattgga

SEQ ID NO: 92 - DNA, 60 bp, Artificial Sequence
  Synthetic oligonucleotide probe
tttggcagctcctcaacttccggcattacgggcgacaatacgacaacatcctctgagccc

SEQ ID NO: 93 - DNA, 60 bp, Artificial Sequence
  Synthetic oligonucleotide probe
acggtggtcctcaccgaatcaaccctatctactgccttggccgagcttgccaccaaaagt

SEQ ID NO: 94 - DNA, 60 bp, Artificial Sequence
  Synthetic oligonucleotide probe
tagtagagacgtggaaaaagcctgactacgaaccacctgtggtccatggctgcccgctac

SEQ ID NO: 95 - DNA, 60 bp, Artificial Sequence
  Synthetic oligonucleotide probe
aacaaagtggtgattctggactccttcgatccgcttgtggcagaggaggatgagcgggag

SEQ ID NO: 96 - DNA, 60 bp, Artificial Sequence
  Synthetic oligonucleotide probe
aaccggacgtagccgtgttgacgtccatgctcactgatccctcccatataacagcagagg

SEQ ID NO: 97 - DNA, 60 bp, Artificial Sequence
  Synthetic oligonucleotide probe
aggtatcattcagagtaggactccacgagtacccggtggggtcgcaattaccttgcgagc

SEQ ID NO: 98 - DNA, 60 bp, Artificial Sequence
  Synthetic oligonucleotide probe
tgcagaggaatacgtggagataaggcgggtgggggacttccactacgtatcgggtatgac

SEQ ID NO: 99 - DNA, 60 bp, Artificial Sequence
  Synthetic oligonucleotide probe
atgaggatcgtcggtcctaggacctgcaggaacatgtggagtgggacgttccccattaac

SEQ ID NO: 100 - DNA, 60 bp, Artificial Sequence
  Synthetic oligonucleotide probe
attatgcacactcgctgccactgtggagctgagatcactggacatgtcaaaaacgggacg

SEQ ID NO: 101 - DNA, 60 bp, Artificial Sequence
  Synthetic oligonucleotide probe
atgtggcaagtacctcttcaactgggcagtaagaacaaagctcaaactcactccaatagc

SEQ ID NO: 102 - DNA, 60 bp, Artificial Sequence
  Synthetic oligonucleotide probe
tatgtggcaagtacctcttcaactgggcagtaagaacaaagctcaaactcactccaatag

SEQ ID NO: 103 - DNA, 60 bp, Artificial Sequence
  Synthetic oligonucleotide probe
atatgtggcaagtacctcttcaactgggcagtaagaacaaagctcaaactcactccaata

SEQ ID NO: 104 - DNA, 60 bp, Artificial Sequence
  Synthetic oligonucleotide probe
catatgtggcaagtacctcttcaactgggcagtaagaacaaagctcaaactcactccaat

SEQ ID NO: 105 - DNA, 60 bp, Artificial Sequence
  Synthetic oligonucleotide probe
ccatatgtggcaagtacctcttcaactgggcagtaagaacaaagctcaaactcactccaa

SEQ ID NO: 106 - DNA, 60 bp, Artificial Sequence
  Synthetic oligonucleotide probe
aaagactccatggcctcagcgcattttcactccacagttactctccaggtgaaatcaata

SEQ ID NO: 107 - DNA, 60 bp, Artificial Sequence
  Synthetic oligonucleotide probe
tttctttagcgtcctcatagccagggatcagcttgaacaggctcttaactgtgagatcta

SEQ ID NO: 108 - DNA, 60 bp, Artificial Sequence
  Synthetic oligonucleotide probe
atttctttagcgtcctcatagccagggatcagcttgaacaggctcttaactgtgagatct

SEQ ID NO: 109 - DNA, 60 bp, Artificial Sequence
  Synthetic oligonucleotide probe
acataatcatgtttgcccccacactgtgggcgaggatgatactgatgacccatttcttta

SEQ ID NO: 110 - DNA, 60 bp, Artificial Sequence
  Synthetic oligonucleotide probe
aacataatcatgtttgcccccacactgtgggcgaggatgatactgatgacccatttcttt

SEQ ID NO: 111 - DNA, 60 bp, Artificial Sequence
  Synthetic oligonucleotide probe
aagactgctagccgagtagcgttgggttgcgaaaggccttgtggtactgcctgatagggt

SEQ ID NO: 112 - DNA, 60 bp, Artificial Sequence
  Synthetic oligonucleotide probe
attgccgggaagactgggtcctttcttggataaacccactctatgcccggccatttgggc

SEQ ID NO: 113 - DNA, 60 bp, Artificial Sequence
  Synthetic oligonucleotide probe
aattgccgggaagactgggtcctttcttggataaacccactctatgcccggccatttggg

SEQ ID NO: 114 - DNA, 60 bp, Artificial Sequence
  Synthetic oligonucleotide probe
gaattgccgggaagactgggtcctttcttggataaacccactctatgcccggccatttgg

SEQ ID NO: 115 - DNA, 60 bp, Artificial Sequence
  Synthetic oligonucleotide probe
ggaattgccgggaagactgggtcctttcttggataaacccactctatgcccggccatttg

SEQ ID NO: 116 - DNA, 60 bp, Artificial Sequence
  Synthetic oligonucleotide probe
cggaattgccgggaagactgggtcctttcttggataaacccactctatgcccggccattt

SEQ ID NO: 117 - DNA, 60 bp, Artificial Sequence
  Synthetic oligonucleotide probe
ccggaattgccgggaagactgggtcctttcttggataaacccactctatgcccggccatt

SEQ ID NO: 118 - DNA, 60 bp, Artificial Sequence
  Synthetic oligonucleotide probe
accggaattgccgggaagactgggtcctttcttggataaacccactctatgcccggccat

SEQ ID NO: 119 - DNA, 60 bp, Artificial Sequence
  Synthetic oligonucleotide probe
tacaccggaattgccgggaagactgggtcctttcttggataaacccactctatgcccggc

SEQ ID NO: 120 - DNA, 60 bp, Artificial Sequence
  Synthetic oligonucleotide probe
gtacaccggaattgccgggaagactgggtcctttcttggataaacccactctatgcccgg

SEQ ID NO: 121 - DNA, 60 bp, Artificial Sequence
  Synthetic oligonucleotide probe
aacctcaaagaaaaaccaaaagaaacaccaaccgtcgcccacaagacgttaagtttccgg

SEQ ID NO: 122 - DNA, 60 bp, Artificial Sequence
  Synthetic oligonucleotide probe
aaacctcaaagaaaaaccaaaagaaacaccaaccgtcgcccacaagacgttaagtttccg

SEQ ID NO: 123 - DNA, 60 bp, Artificial Sequence
  Synthetic oligonucleotide probe
taaacctcaaagaaaaaccaaaagaaacaccaaccgtcgcccacaagacgttaagtttcc

SEQ ID NO: 124 - DNA, 60 bp, Artificial Sequence
  Synthetic oligonucleotide probe
ctaaacctcaaagaaaaaccaaaagaaacaccaaccgtcgcccacaagacgttaagtttc

SEQ ID NO: 125 - DNA, 60 bp, Artificial Sequence
  Synthetic oligonucleotide probe
cctaaacctcaaagaaaaaccaaaagaaacaccaaccgtcgcccacaagacgttaagttt

SEQ ID NO: 126 - DNA, 60 bp, Artificial Sequence
  Synthetic oligonucleotide probe
tcctaaacctcaaagaaaaaccaaaagaaacaccaaccgtcgcccacaagacgttaagtt

SEQ ID NO: 127 - DNA, 60 bp, Artificial Sequence
  Synthetic oligonucleotide probe
atcctaaacctcaaagaaaaaccaaaagaaacaccaaccgtcgcccacaagacgttaagt

SEQ ID NO: 128 - DNA, 60 bp, Artificial Sequence
  Synthetic oligonucleotide probe
aatcctaaacctcaaagaaaaaccaaaagaaacaccaaccgtcgcccacaagacgttaag

SEQ ID NO: 129 - DNA, 60 bp, Artificial Sequence
  Synthetic oligonucleotide probe
aaatcctaaacctcaaagaaaaaccaaaagaaacaccaaccgtcgcccacaagacgttaa

SEQ ID NO: 130 - DNA, 60 bp, Artificial Sequence
  Synthetic oligonucleotide probe
gtgcaccatgagcacaaatcctaaacctcaaagaaaaaccaaaagaaacaccaaccgtcg

SEQ ID NO: 131 - DNA, 60 bp, Artificial Sequence
  Synthetic oligonucleotide probe
ttggcctacttctctatgcagggagcgtgggcgaaagtcgttgtcatccttctgttggcc

SEQ ID NO: 132 - DNA, 60 bp, Artificial Sequence
  Synthetic oligonucleotide probe
atcattagcggggctcattggggcgtcatgttcggcttggcctacttctctatgcaggga

SEQ ID NO: 133 - DNA, 60 bp, Artificial Sequence
  Synthetic oligonucleotide probe
tccccgaggtcattatagacatcattagcggggctcattggggcgtcatgttcggcttgg

SEQ ID NO: 134 - DNA, 60 bp, Artificial Sequence
  Synthetic oligonucleotide probe
cttggcgtacgcgatgcgtgtccccgaggtcattatagacatcattagcggggctcattg

SEQ ID NO: 135 - DNA, 60 bp, Artificial Sequence
  Synthetic oligonucleotide probe
tggacaccgcatggcatgggacatgatgatgaactggtcgcccacggctaccatgatctt

SEQ ID NO: 136 - DNA, 60 bp, Artificial Sequence
  Synthetic oligonucleotide probe
atctaccctggtaccatcactggacaccgcatggcatgggacatgatgatgaactggtcg

SEQ ID NO: 137 - DNA, 60 bp, Artificial Sequence
  Synthetic oligonucleotide probe
tccaagactgcaattgctccatctaccctggtaccatcactggacaccgcatggcatggg

SEQ ID NO: 138 - DNA, 60 bp, Artificial Sequence
  Synthetic oligonucleotide probe
tgtctcgccgcagcaccactggtttgtccaagactgcaattgctccatctaccctggtac

SEQ ID NO: 139 - DNA, 60 bp, Artificial Sequence
  Synthetic oligonucleotide probe
ctcgcagcccaaatgttcattgtctcgccgcagcaccactggtttgtccaagactgcaat

SEQ ID NO: 140 - DNA, 60 bp, Artificial Sequence
  Synthetic oligonucleotide probe
atggtgactaacgactgcaccaatgacagcattacctggcagctccaggctgctgtcctc

SEQ ID NO: 141 - DNA, 60 bp, Artificial Sequence
  Synthetic oligonucleotide probe
aacatcgtggacgtacaattcatgtatggcctatcacctgccctcacaaaatacatcgtc

SEQ ID NO: 142 - DNA, 60 bp, Artificial Sequence
  Synthetic oligonucleotide probe
aaacatcgtggacgtacaattcatgtatggcctatcacctgccctcacaaaatacatcgt

SEQ ID NO: 143 - DNA, 60 bp, Artificial Sequence
  Synthetic oligonucleotide probe
caaaacatcgtggacgtacaattcatgtatggcctatcacctgccctcacaaaatacatc

SEQ ID NO: 144 - DNA, 60 bp, Artificial Sequence
  Synthetic oligonucleotide probe
ccaaaacatcgtggacgtacaattcatgtatggcctatcacctgccctcacaaaatacat

SEQ ID NO: 145 - DNA, 60 bp, Artificial Sequence
  Synthetic oligonucleotide probe
accaaaacatcgtggacgtacaattcatgtatggcctatcacctgccctcacaaaataca

SEQ ID NO: 146 - DNA, 60 bp, Artificial Sequence
  Synthetic oligonucleotide probe
ttaactataccatcttcaaaataaggatgtatgtgggaggggttgagcacaggctcacgg

SEQ ID NO: 147 - DNA, 60 bp, Artificial Sequence
  Synthetic oligonucleotide probe
gttaactataccatcttcaaaataaggatgtatgtgggaggggttgagcacaggctcacg

SEQ ID NO: 148 - DNA, 60 bp, Artificial Sequence
  Synthetic oligonucleotide probe
agttaactataccatcttcaaaataaggatgtatgtgggaggggttgagcacaggctcac

SEQ ID NO: 149 - DNA, 60 bp, Artificial Sequence
  Synthetic oligonucleotide probe
cagttaactataccatcttcaaaataaggatgtatgtgggaggggttgagcacaggctca

SEQ ID NO: 150 - DNA, 60 bp, Artificial Sequence
  Synthetic oligonucleotide probe
acagttaactataccatcttcaaaataaggatgtatgtgggaggggttgagcacaggctc

SEQ ID NO: 151 - DNA, 60 bp, Artificial Sequence
  Synthetic oligonucleotide probe
tcattgtctggggagcggagacagctgcttgtggggacattttacacggacttcccgtgt

SEQ ID NO: 152 - DNA, 60 bp, Artificial Sequence
  Synthetic oligonucleotide probe
gccgttgagcctatcatcttcagtccgatggagaagaaagtcattgtctggggagcggag

SEQ ID NO: 153 - DNA, 60 bp, Artificial Sequence
  Synthetic oligonucleotide probe
actggcacttacatctatgaccacctcacccctatgtcggattgggctgctagtggcctg

SEQ ID NO: 154 - DNA, 60 bp, Artificial Sequence
  Synthetic oligonucleotide probe
caggtacgtccagatggcgctactagcccttggcaggtggactggcacttacatctatga

SEQ ID NO: 155 - DNA, 60 bp, Artificial Sequence
  Synthetic oligonucleotide probe
taaaaggtgctttgacgcgcgtgccgtacttcgtcagggctcacgctctactgaggatgt

SEQ ID NO: 156 - DNA, 60 bp, Artificial Sequence
  Synthetic oligonucleotide probe
taaccaagtggctcttggcggtgcttgggcctgcttacctcctaaaaggtgctttgacgc

SEQ ID NO: 157 - DNA, 60 bp, Artificial Sequence
  Synthetic oligonucleotide probe
tgggccgtcgccatattctacccaggtgtggtgtttgacataaccaagtggctcttggcg

SEQ ID NO: 158 - DNA, 60 bp, Artificial Sequence
  Synthetic oligonucleotide probe
ttttgtggtggttgtgctatcttctgaccctgggggaagctatggtccaggagtgggcac

SEQ ID NO: 159 - DNA, 60 bp, Artificial Sequence
  Synthetic oligonucleotide probe
tttactctcacccccgggtataagacccttctcagccggtttttgtggtggttgtgctat

SEQ ID NO: 160 - DNA, 60 bp, Artificial Sequence
  Synthetic oligonucleotide probe
tggccagataggagcggctctgctggtaatgatcactctctttactctcacccccgggta

SEQ ID NO: 161 - DNA, 60 bp, Artificial Sequence
  Synthetic oligonucleotide probe
acatcaagggaggaagacatctgatcttctgccattcaaagaaaaagtgtgacgagctcg

SEQ ID NO: 162 - DNA, 60 bp, Artificial Sequence
  Synthetic oligonucleotide probe
tacatcaagggaggaagacatctgatcttctgccattcaaagaaaaagtgtgacgagctc

SEQ ID NO: 163 - DNA, 60 bp, Artificial Sequence
  Synthetic oligonucleotide probe
ttacatcaagggaggaagacatctgatcttctgccattcaaagaaaaagtgtgacgagct

SEQ ID NO: 164 - DNA, 60 bp, Artificial Sequence
  Synthetic oligonucleotide probe
cttacatcaagggaggaagacatctgatcttctgccattcaaagaaaaagtgtgacgagc

SEQ ID NO: 165 - DNA, 60 bp, Artificial Sequence
  Synthetic oligonucleotide probe
tcttacatcaagggaggaagacatctgatcttctgccattcaaagaaaaagtgtgacgag

SEQ ID NO: 166 - DNA, 60 bp, Artificial Sequence
  Synthetic oligonucleotide probe
gtcttacatcaagggaggaagacatctgatcttctgccattcaaagaaaaagtgtgacga

SEQ ID NO: 167 - DNA, 60 bp, Artificial Sequence
  Synthetic oligonucleotide probe
tgtcttacatcaagggaggaagacatctgatcttctgccattcaaagaaaaagtgtgacg

SEQ ID NO: 168 - DNA, 60 bp, Artificial Sequence
  Synthetic oligonucleotide probe
ctgtcttacatcaagggaggaagacatctgatcttctgccattcaaagaaaaagtgtgac

SEQ ID NO: 169 - DNA, 60 bp, Artificial Sequence
  Synthetic oligonucleotide probe
cctgtcttacatcaagggaggaagacatctgatcttctgccattcaaagaaaaagtgtga

SEQ ID NO: 170 - DNA, 60 bp, Artificial Sequence
  Synthetic oligonucleotide probe
ccctgtcttacatcaagggaggaagacatctgatcttctgccattcaaagaaaaagtgtg

SEQ ID NO: 171 - DNA, 60 bp, Artificial Sequence
  Synthetic oligonucleotide probe
acaaggaggtcctctatgaggcttttgatgagatggaggaatgtgcctctagggcggctc

SEQ ID NO: 172 - DNA, 60 bp, Artificial Sequence
  Synthetic oligonucleotide probe
gacaaggaggtcctctatgaggcttttgatgagatggaggaatgtgcctctagggcggct

SEQ ID NO: 173 - DNA, 60 bp, Artificial Sequence
  Synthetic oligonucleotide probe
ggacaaggaggtcctctatgaggcttttgatgagatggaggaatgtgcctctagggcggc

SEQ ID NO: 174 - DNA, 60 bp, Artificial Sequence
  Synthetic oligonucleotide probe
cggacaaggaggtcctctatgaggcttttgatgagatggaggaatgtgcctctagggcgg

SEQ ID NO: 175 - DNA, 60 bp, Artificial Sequence
  Synthetic oligonucleotide probe
ccggacaaggaggtcctctatgaggcttttgatgagatggaggaatgtgcctctagggcg

SEQ ID NO: 176 - DNA, 60 bp, Artificial Sequence
  Synthetic oligonucleotide probe
gccggacaaggaggtcctctatgaggcttttgatgagatggaggaatgtgcctctagggc

SEQ ID NO: 177 - DNA, 60 bp, Artificial Sequence
  Synthetic oligonucleotide probe
cgccggacaaggaggtcctctatgaggcttttgatgagatggaggaatgtgcctctaggg

SEQ ID NO: 178 - DNA, 60 bp, Artificial Sequence
  Synthetic oligonucleotide probe
gcgccggacaaggaggtcctctatgaggcttttgatgagatggaggaatgtgcctctagg

SEQ ID NO: 179 - DNA, 60 bp, Artificial Sequence
  Synthetic oligonucleotide probe
tgcgccggacaaggaggtcctctatgaggcttttgatgagatggaggaatgtgcctctag

SEQ ID NO: 180 - DNA, 60 bp, Artificial Sequence
  Synthetic oligonucleotide probe
ttgcgccggacaaggaggtcctctatgaggcttttgatgagatggaggaatgtgcctcta

SEQ ID NO: 181 - DNA, 60 bp, Artificial Sequence
  Synthetic oligonucleotide probe
aaggtagaacaattctgggccaaacacatgtggaacttcattagcggcatccaatacctc

SEQ ID NO: 182 - DNA, 60 bp, Artificial Sequence
  Synthetic oligonucleotide probe
caaggtagaacaattctgggccaaacacatgtggaacttcattagcggcatccaatacct

SEQ ID NO: 183 - DNA, 60 bp, Artificial Sequence
  Synthetic oligonucleotide probe
aagatccaaggcttattgcagcaagcttccaaacaagctcaagacatacaacccactgtg

SEQ ID NO: 184 - DNA, 60 bp, Artificial Sequence
  Synthetic oligonucleotide probe
caagatccaaggcttattgcagcaagcttccaaacaagctcaagacatacaacccactgt

SEQ ID NO: 185 - DNA, 60 bp, Artificial Sequence
  Synthetic oligonucleotide probe
agtccaagatccaaggcttattgcagcaagcttccaaacaagctcaagacatacaaccca

SEQ ID NO: 186 - DNA, 60 bp, Artificial Sequence
  Synthetic oligonucleotide probe
aagtccaagatccaaggcttattgcagcaagcttccaaacaagctcaagacatacaaccc

SEQ ID NO: 187 - DNA, 60 bp, Artificial Sequence
  Synthetic oligonucleotide probe
gaagtccaagatccaaggcttattgcagcaagcttccaaacaagctcaagacatacaacc

SEQ ID NO: 188 - DNA, 60 bp, Artificial Sequence
  Synthetic oligonucleotide probe
tgaagtccaagatccaaggcttattgcagcaagcttccaaacaagctcaagacatacaac

SEQ ID NO: 189 - DNA, 60 bp, Artificial Sequence
  Synthetic oligonucleotide probe
ctgaagtccaagatccaaggcttattgcagcaagcttccaaacaagctcaagacatacaa

SEQ ID NO: 190 - DNA, 60 bp, Artificial Sequence
  Synthetic oligonucleotide probe
gctgaagtccaagatccaaggcttattgcagcaagcttccaaacaagctcaagacataca

SEQ ID NO: 191 - DNA, 60 bp, Artificial Sequence
  Synthetic oligonucleotide probe
agactttaaaaattggctgacctccaaattattcccaaagatgcccggcctcccctttgt

SEQ ID NO: 192 - DNA, 60 bp, Artificial Sequence
  Synthetic oligonucleotide probe
atcctaacagactttaaaaattggctgacctccaaattattcccaaagatgcccggcctc

SEQ ID NO: 193 - DNA, 60 bp, Artificial Sequence
  Synthetic oligonucleotide probe
catcctaacagactttaaaaattggctgacctccaaattattcccaaagatgcccggcct

SEQ ID NO: 194 - DNA, 60 bp, Artificial Sequence
  Synthetic oligonucleotide probe
accatcctaacagactttaaaaattggctgacctccaaattattcccaaagatgcccggc

SEQ ID NO: 195 - DNA, 60 bp, Artificial Sequence
  Synthetic oligonucleotide probe
caccatcctaacagactttaaaaattggctgacctccaaattattcccaaagatgcccgg

SEQ ID NO: 196 - DNA, 60 bp, Artificial Sequence
  Synthetic oligonucleotide probe
gcaccatcctaacagactttaaaaattggctgacctccaaattattcccaaagatgcccg

SEQ ID NO: 197 - DNA, 60 bp, Artificial Sequence
  Synthetic oligonucleotide probe
tgcaccatcctaacagactttaaaaattggctgacctccaaattattcccaaagatgccc

SEQ ID NO: 198 - DNA, 60 bp, Artificial Sequence
  Synthetic oligonucleotide probe
ttgcaccatcctaacagactttaaaaattggctgacctccaaattattcccaaagatgcc

SEQ ID NO: 199 - DNA, 60 bp, Artificial Sequence
  Synthetic oligonucleotide probe
tttgcaccatcctaacagactttaaaaattggctgacctccaaattattcccaaagatgc

SEQ ID NO: 200 - DNA, 60 bp, Artificial Sequence
  Synthetic oligonucleotide probe
gtttgcaccatcctaacagactttaaaaattggctgacctccaaattattcccaaagatg

SEQ ID NO: 201 - DNA, 60 bp, Artificial Sequence
  Synthetic oligonucleotide probe
aattgaaaggttacatgggcttgacgctttttctctgcacacatacactccccacgaact

SEQ ID NO: 202 - DNA, 60 bp, Artificial Sequence
  Synthetic oligonucleotide probe
taattgaaaggttacatgggcttgacgctttttctctgcacacatacactccccacgaac

SEQ ID NO: 203 - DNA, 60 bp, Artificial Sequence
  Synthetic oligonucleotide probe
ataattgaaaggttacatgggcttgacgctttttctctgcacacatacactccccacgaa

SEQ ID NO: 204 - DNA, 60 bp, Artificial Sequence
  Synthetic oligonucleotide probe
tataattgaaaggttacatgggcttgacgctttttctctgcacacatacactccccacga

SEQ ID NO: 205 - DNA, 60 bp, Artificial Sequence
  Synthetic oligonucleotide probe
ctataattgaaaggttacatgggcttgacgctttttctctgcacacatacactccccacg

SEQ ID NO: 206 - DNA, 60 bp, Artificial Sequence
  Synthetic oligonucleotide probe
gctataattgaaaggttacatgggcttgacgctttttctctgcacacatacactccccac

SEQ ID NO: 207 - DNA, 60 bp, Artificial Sequence
  Synthetic oligonucleotide probe
agctataattgaaaggttacatgggcttgacgctttttctctgcacacatacactcccca

SEQ ID NO: 208 - DNA, 60 bp, Artificial Sequence
  Synthetic oligonucleotide probe
cagctataattgaaaggttacatgggcttgacgctttttctctgcacacatacactcccc

SEQ ID NO: 209 - DNA, 60 bp, Artificial Sequence
  Synthetic oligonucleotide probe
ccagctataattgaaaggttacatgggcttgacgctttttctctgcacacatacactccc

SEQ ID NO: 210 - DNA, 60 bp, Artificial Sequence
  Synthetic oligonucleotide probe
cccagctataattgaaaggttacatgggcttgacgctttttctctgcacacatacactcc

SEQ ID NO: 211 - DNA, 60 bp, Artificial Sequence
  Synthetic oligonucleotide probe
tcactagccgagtagtgttgggtcgcgaaaggccttgtggtactgcctgatagggtgctt

SEQ ID NO: 212 - DNA, 60 bp, Artificial Sequence
  Synthetic oligonucleotide probe
atcactagccgagtagtgttgggtcgcgaaaggccttgtggtactgcctgatagggtgct

SEQ ID NO: 213 - DNA, 60 bp, Artificial Sequence
  Synthetic oligonucleotide probe
agatcactagccgagtagtgttgggtcgcgaaaggccttgtggtactgcctgatagggtg

SEQ ID NO: 214 - DNA, 60 bp, Artificial Sequence
  Synthetic oligonucleotide probe
gagatcactagccgagtagtgttgggtcgcgaaaggccttgtggtactgcctgatagggt

SEQ ID NO: 215 - DNA, 60 bp, Artificial Sequence
  Synthetic oligonucleotide probe
tttcttggagcaacccgctcaatacccagaaatttgggcgtgcccccgcgagatcactag

SEQ ID NO: 216 - DNA, 60 bp, Artificial Sequence
  Synthetic oligonucleotide probe
ctttcttggagcaacccgctcaatacccagaaatttgggcgtgcccccgcgagatcacta

SEQ ID NO: 217 - DNA, 60 bp, Artificial Sequence
  Synthetic oligonucleotide probe
aatcgctggggtgaccgggtcctttcttggagcaacccgctcaatacccagaaatttggg

SEQ ID NO: 218 - DNA, 60 bp, Artificial Sequence
  Synthetic oligonucleotide probe
gaatcgctggggtgaccgggtcctttcttggagcaacccgctcaatacccagaaatttgg

SEQ ID NO: 219 - DNA, 60 bp, Artificial Sequence
  Synthetic oligonucleotide probe
ggaatcgctggggtgaccgggtcctttcttggagcaacccgctcaatacccagaaatttg

SEQ ID NO: 220 - DNA, 60 bp, Artificial Sequence
  Synthetic oligonucleotide probe
cggaatcgctggggtgaccgggtcctttcttggagcaacccgctcaatacccagaaattt

SEQ ID NO: 221 - DNA, 60 bp, Artificial Sequence
  Synthetic oligonucleotide probe
aaatttcgcaacagggaacttgcccggttgctccttttctatcttccttcttgctctgtt

SEQ ID NO: 222 - DNA, 60 bp, Artificial Sequence
  Synthetic oligonucleotide probe
taaatttcgcaacagggaacttgcccggttgctccttttctatcttccttcttgctctgt

SEQ ID NO: 223 - DNA, 60 bp, Artificial Sequence
  Synthetic oligonucleotide probe
ataaatttcgcaacagggaacttgcccggttgctccttttctatcttccttcttgctctg

SEQ ID NO: 224 - DNA, 60 bp, Artificial Sequence
  Synthetic oligonucleotide probe
gataaatttcgcaacagggaacttgcccggttgctccttttctatcttccttcttgctct

SEQ ID NO: 225 - DNA, 60 bp, Artificial Sequence
  Synthetic oligonucleotide probe
tgctccttttctatcttccttcttgctctgttctcttgcttaattcatccagcagccagt

SEQ ID NO: 226 - DNA, 60 bp, Artificial Sequence
  Synthetic oligonucleotide probe
ttgctccttttctatcttccttcttgctctgttctcttgcttaattcatccagcagccag

SEQ ID NO: 227 - DNA, 60 bp, Artificial Sequence
  Synthetic oligonucleotide probe
gttgctccttttctatcttccttcttgctctgttctcttgcttaattcatccagcagcca

SEQ ID NO: 228 - DNA, 60 bp, Artificial Sequence
  Synthetic oligonucleotide probe
aacttgcccggttgctccttttctatcttccttcttgctctgttctcttgcttaattcat

SEQ ID NO: 229 - DNA, 60 bp, Artificial Sequence
  Synthetic oligonucleotide probe
gaacttgcccggttgctccttttctatcttccttcttgctctgttctcttgcttaattca

SEQ ID NO: 230 - DNA, 60 bp, Artificial Sequence
  Synthetic oligonucleotide probe
gggaacttgcccggttgctccttttctatcttccttcttgctctgttctcttgcttaatt

SEQ ID NO: 231 - DNA, 60 bp, Artificial Sequence
  Synthetic oligonucleotide probe
accaacgactgttccaatagcagtattgtgtatgaggccgatgatgtcattctgcacaca

SEQ ID NO: 232 - DNA, 60 bp, Artificial Sequence
  Synthetic oligonucleotide probe
taccaacgactgttccaatagcagtattgtgtatgaggccgatgatgtcattctgcacac

SEQ ID NO: 233 - DNA, 60 bp, Artificial Sequence
  Synthetic oligonucleotide probe
ttaccaacgactgttccaatagcagtattgtgtatgaggccgatgatgtcattctgcaca

SEQ ID NO: 234 - DNA, 60 bp, Artificial Sequence
  Synthetic oligonucleotide probe
cttaccaacgactgttccaatagcagtattgtgtatgaggccgatgatgtcattctgcac

SEQ ID NO: 235 - DNA, 60 bp, Artificial Sequence
  Synthetic oligonucleotide probe
ccttaccaacgactgttccaatagcagtattgtgtatgaggccgatgatgtcattctgca

SEQ ID NO: 236 - DNA, 60 bp, Artificial Sequence
  Synthetic oligonucleotide probe
tccttaccaacgactgttccaatagcagtattgtgtatgaggccgatgatgtcattctgc

SEQ ID NO: 237 - DNA, 60 bp, Artificial Sequence
  Synthetic oligonucleotide probe
gtccttaccaacgactgttccaatagcagtattgtgtatgaggccgatgatgtcattctg

SEQ ID NO: 238 - DNA, 60 bp, Artificial Sequence
  Synthetic oligonucleotide probe
cgtccttaccaacgactgttccaatagcagtattgtgtatgaggccgatgatgtcattct

SEQ ID NO: 239 - DNA, 60 bp, Artificial Sequence
  Synthetic oligonucleotide probe
acgtccttaccaacgactgttccaatagcagtattgtgtatgaggccgatgatgtcattc

SEQ ID NO: 240 - DNA, 60 bp, Artificial Sequence
  Synthetic oligonucleotide probe
tacgtccttaccaacgactgttccaatagcagtattgtgtatgaggccgatgatgtcatt

SEQ ID NO: 241 - DNA, 60 bp, Artificial Sequence
  Synthetic oligonucleotide probe
tcaacaggtctgatacacctccaccaaaacatcgtggatgtccaatacctttatggcgtt

SEQ ID NO: 242 - DNA, 60 bp, Artificial Sequence
  Synthetic oligonucleotide probe
atttcagattgttcaaggtgaggatgtttgtgggtgggtttgaacatcgatttaccgccg

SEQ ID NO: 243 - DNA, 60 bp, Artificial Sequence
  Synthetic oligonucleotide probe
gatttcagattgttcaaggtgaggatgtttgtgggtgggtttgaacatcgatttaccgcc

SEQ ID NO: 244 - DNA, 60 bp, Artificial Sequence
  Synthetic oligonucleotide probe
cgatttcagattgttcaaggtgaggatgtttgtgggtgggtttgaacatcgatttaccgc

SEQ ID NO: 245 - DNA, 60 bp, Artificial Sequence
  Synthetic oligonucleotide probe
tcgatttcagattgttcaaggtgaggatgtttgtgggtgggtttgaacatcgatttaccg

SEQ ID NO: 246 - DNA, 60 bp, Artificial Sequence
  Synthetic oligonucleotide probe
gtcgatttcagattgttcaaggtgaggatgtttgtgggtgggtttgaacatcgatttacc

SEQ ID NO: 247 - DNA, 60 bp, Artificial Sequence
  Synthetic oligonucleotide probe
agtcgatttcagattgttcaaggtgaggatgtttgtgggtgggtttgaacatcgatttac

SEQ ID NO: 248 - DNA, 60 bp, Artificial Sequence
  Synthetic oligonucleotide probe
cagtcgatttcagattgttcaaggtgaggatgtttgtgggtgggtttgaacatcgattta

SEQ ID NO: 249 - DNA, 60 bp, Artificial Sequence
  Synthetic oligonucleotide probe
acagtcgatttcagattgttcaaggtgaggatgtttgtgggtgggtttgaacatcgattt

SEQ ID NO: 250 - DNA, 60 bp, Artificial Sequence
  Synthetic oligonucleotide probe
tacagtcgatttcagattgttcaaggtgaggatgtttgtgggtgggtttgaacatcgatt

SEQ ID NO: 251 - DNA, 60 bp, Artificial Sequence
  Synthetic oligonucleotide probe
actgaacctgtaatatttagtcccatggaaatcaaggtcatcacctggggtgcggataca

SEQ ID NO: 252 - DNA, 60 bp, Artificial Sequence
  Synthetic oligonucleotide probe
acctagcagtggccactgaacctgtaatatttagtcccatggaaatcaaggtcatcacct

SEQ ID NO: 253 - DNA, 60 bp, Artificial Sequence
  Synthetic oligonucleotide probe
agacctagcagtggccactgaacctgtaatatttagtcccatggaaatcaaggtcatcac

SEQ ID NO: 254 - DNA, 60 bp, Artificial Sequence
  Synthetic oligonucleotide probe
aagacctagcagtggccactgaacctgtaatatttagtcccatggaaatcaaggtcatca

SEQ ID NO: 255 - DNA, 60 bp, Artificial Sequence
  Synthetic oligonucleotide probe
aaagacctagcagtggccactgaacctgtaatatttagtcccatggaaatcaaggtcatc

SEQ ID NO: 256 - DNA, 60 bp, Artificial Sequence
  Synthetic oligonucleotide probe
caaagacctagcagtggccactgaacctgtaatatttagtcccatggaaatcaaggtcat

SEQ ID NO: 257 - DNA, 60 bp, Artificial Sequence
  Synthetic oligonucleotide probe
tcaaagacctagcagtggccactgaacctgtaatatttagtcccatggaaatcaaggtca

SEQ ID NO: 258 - DNA, 60 bp, Artificial Sequence
  Synthetic oligonucleotide probe
ctcaaagacctagcagtggccactgaacctgtaatatttagtcccatggaaatcaaggtc

SEQ ID NO: 259 - DNA, 60 bp, Artificial Sequence
  Synthetic oligonucleotide probe
tctcaaagacctagcagtggccactgaacctgtaatatttagtcccatggaaatcaaggt

SEQ ID NO: 260 - DNA, 60 bp, Artificial Sequence
  Synthetic oligonucleotide probe
gtctcaaagacctagcagtggccactgaacctgtaatatttagtcccatggaaatcaagg

SEQ ID NO: 261 - DNA, 60 bp, Artificial Sequence
  Synthetic oligonucleotide probe
atagatgcccactttctgtcacagactaagcagcagggacttaacttctcgtacctaact

SEQ ID NO: 262 - DNA, 60 bp, Artificial Sequence
  Synthetic oligonucleotide probe
acatagatgcccactttctgtcacagactaagcagcagggacttaacttctcgtacctaa

SEQ ID NO: 263 - DNA, 60 bp, Artificial Sequence
  Synthetic oligonucleotide probe
aactcacatagatgcccactttctgtcacagactaagcagcagggacttaacttctcgta

SEQ ID NO: 264 - DNA, 60 bp, Artificial Sequence
  Synthetic oligonucleotide probe
taactcacatagatgcccactttctgtcacagactaagcagcagggacttaacttctcgt

SEQ ID NO: 265 - DNA, 60 bp, Artificial Sequence
  Synthetic oligonucleotide probe
actaactcacatagatgcccactttctgtcacagactaagcagcagggacttaacttctc

SEQ ID NO: 266 - DNA, 60 bp, Artificial Sequence
  Synthetic oligonucleotide probe
gactaactcacatagatgcccactttctgtcacagactaagcagcagggacttaacttct

SEQ ID NO: 267 - DNA, 60 bp, Artificial Sequence
  Synthetic oligonucleotide probe
tggactaactcacatagatgcccactttctgtcacagactaagcagcagggacttaactt

SEQ ID NO: 268 - DNA, 60 bp, Artificial Sequence
  Synthetic oligonucleotide probe
ttagacttttgggagagcgtcttcactggactaactcacatagatgcccactttctgtca

SEQ ID NO: 269 - DNA, 60 bp, Artificial Sequence
  Synthetic oligonucleotide probe
tttagacttttgggagagcgtcttcactggactaactcacatagatgcccactttctgtc

SEQ ID NO: 270 - DNA, 60 bp, Artificial Sequence
  Synthetic oligonucleotide probe
atttagacttttgggagagcgtcttcactggactaactcacatagatgcccactttctgt

SEQ ID NO: 271 - DNA, 60 bp, Artificial Sequence
  Synthetic oligonucleotide probe
ccagcactcgttccagacaaagaggtgttgtatcaacaatacgatgagatggaggagtgc

SEQ ID NO: 272 - DNA, 60 bp, Artificial Sequence
  Synthetic oligonucleotide probe
gccagcactcgttccagacaaagaggtgttgtatcaacaatacgatgagatggaggagtg

SEQ ID NO: 273 - DNA, 60 bp, Artificial Sequence
  Synthetic oligonucleotide probe
agccagcactcgttccagacaaagaggtgttgtatcaacaatacgatgagatggaggagt

SEQ ID NO: 274 - DNA, 60 bp, Artificial Sequence
  Synthetic oligonucleotide probe
aagccagcactcgttccagacaaagaggtgttgtatcaacaatacgatgagatggaggag

SEQ ID NO: 275 - DNA, 60 bp, Artificial Sequence
  Synthetic oligonucleotide probe
caagccagcactcgttccagacaaagaggtgttgtatcaacaatacgatgagatggagga

SEQ ID NO: 276 - DNA, 60 bp, Artificial Sequence
  Synthetic oligonucleotide probe
gcaagccagcactcgttccagacaaagaggtgttgtatcaacaatacgatgagatggagg

SEQ ID NO: 277 - DNA, 60 bp, Artificial Sequence
  Synthetic oligonucleotide probe
ggcaagccagcactcgttccagacaaagaggtgttgtatcaacaatacgatgagatggag

SEQ ID NO: 278 - DNA, 60 bp, Artificial Sequence
  Synthetic oligonucleotide probe
gggcaagccagcactcgttccagacaaagaggtgttgtatcaacaatacgatgagatgga

SEQ ID NO: 279 - DNA, 60 bp, Artificial Sequence
  Synthetic oligonucleotide probe
agggcaagccagcactcgttccagacaaagaggtgttgtatcaacaatacgatgagatgg

SEQ ID NO: 280 - DNA, 60 bp, Artificial Sequence
  Synthetic oligonucleotide probe
gagggcaagccagcactcgttccagacaaagaggtgttgtatcaacaatacgatgagatg

SEQ ID NO: 281 - DNA, 60 bp, Artificial Sequence
  Synthetic oligonucleotide probe
tatggcgttcactgcttcagtcaccagtcccctgacgaccaaccaaactatgttttttaa

SEQ ID NO: 282 - DNA, 60 bp, Artificial Sequence
  Synthetic oligonucleotide probe
ttatggcgttcactgcttcagtcaccagtcccctgacgaccaaccaaactatgtttttta

SEQ ID NO: 283 - DNA, 60 bp, Artificial Sequence
  Synthetic oligonucleotide probe
aagcttgaggccttctggcacaagcatatgtggaattttgtgagtgggatccaataccta

SEQ ID NO: 284 - DNA, 60 bp, Artificial Sequence
  Synthetic oligonucleotide probe
aaagcttgaggccttctggcacaagcatatgtggaattttgtgagtgggatccaatacct

SEQ ID NO: 285 - DNA, 60 bp, Artificial Sequence
  Synthetic oligonucleotide probe
caaaagcttgaggccttctggcacaagcatatgtggaattttgtgagtgggatccaatac

SEQ ID NO: 286 - DNA, 60 bp, Artificial Sequence
  Synthetic oligonucleotide probe
gcaaaagcttgaggccttctggcacaagcatatgtggaattttgtgagtgggatccaata

SEQ ID NO: 287 - DNA, 60 bp, Artificial Sequence
  Synthetic oligonucleotide probe
actaccaactggcaaaagcttgaggccttctggcacaagcatatgtggaattttgtgagt

SEQ ID NO: 288 - DNA, 60 bp, Artificial Sequence
  Synthetic oligonucleotide probe
aactaccaactggcaaaagcttgaggccttctggcacaagcatatgtggaattttgtgag

SEQ ID NO: 289 - DNA, 60 bp, Artificial Sequence
  Synthetic oligonucleotide probe
taactaccaactggcaaaagcttgaggccttctggcacaagcatatgtggaattttgtga

SEQ ID NO: 290 - DNA, 60 bp, Artificial Sequence
  Synthetic oligonucleotide probe
gtaactaccaactggcaaaagcttgaggccttctggcacaagcatatgtggaattttgtg

SEQ ID NO: 291 - DNA, 60 bp, Artificial Sequence
  Synthetic oligonucleotide probe
tgatatcactttcatggtagggttgcattcctacacgataggatctcaactcccctgtga

SEQ ID NO: 292 - DNA, 60 bp, Artificial Sequence
  Synthetic oligonucleotide probe
atgatatcactttcatggtagggttgcattcctacacgataggatctcaactcccctgtg

SEQ ID NO: 293 - DNA, 60 bp, Artificial Sequence
  Synthetic oligonucleotide probe
gatgatatcactttcatggtagggttgcattcctacacgataggatctcaactcccctgt

SEQ ID NO: 294 - DNA, 60 bp, Artificial Sequence
  Synthetic oligonucleotide probe
agatgatatcactttcatggtagggttgcattcctacacgataggatctcaactcccctg

SEQ ID NO: 295 - DNA, 60 bp, Artificial Sequence
  Synthetic oligonucleotide probe
gagatgatatcactttcatggtagggttgcattcctacacgataggatctcaactcccct

SEQ ID NO: 296 - DNA, 60 bp, Artificial Sequence
  Synthetic oligonucleotide probe
agagatgatatcactttcatggtagggttgcattcctacacgataggatctcaactcccc

SEQ ID NO: 297 - DNA, 60 bp, Artificial Sequence
  Synthetic oligonucleotide probe
gagagatgatatcactttcatggtagggttgcattcctacacgataggatctcaactccc

SEQ ID NO: 298 - DNA, 60 bp, Artificial Sequence
  Synthetic oligonucleotide probe
tgagagatgatatcactttcatggtagggttgcattcctacacgataggatctcaactcc

SEQ ID NO: 299 - DNA, 60 bp, Artificial Sequence
  Synthetic oligonucleotide probe
ttgagagatgatatcactttcatggtagggttgcattcctacacgataggatctcaactc

SEQ ID NO: 300 - DNA, 60 bp, Artificial Sequence
  Synthetic oligonucleotide probe
gttgagagatgatatcactttcatggtagggttgcattcctacacgataggatctcaact

SEQ ID NO: 301 - DNA, 60 bp, Artificial Sequence
  Synthetic oligonucleotide probe
aaaggctaaaatatgcggcctttatctctttaattgggcggtacgcaccaagaccaacct

SEQ ID NO: 302 - DNA, 60 bp, Artificial Sequence
  Synthetic oligonucleotide probe
atttaccagcaatcattgaaagactccatggtctaagcgcgttcacgctccacagttact

SEQ ID NO: 303 - DNA, 60 bp, Artificial Sequence
  Synthetic oligonucleotide probe
cacttattctgtcactccgctggatttaccagcaatcattgaaagactccatggtctaag

SEQ ID NO: 304 - DNA, 60 bp, Artificial Sequence
  Synthetic oligonucleotide probe
gactttgaaatgtacggggccacttattctgtcactccgctggatttaccagcaatcatt

SEQ ID NO: 305 - DNA, 60 bp, Artificial Sequence
  Synthetic oligonucleotide probe
actttttctccatactccaatcccaggagatacttgatcgcccccttgactttgaaatgt

SEQ ID NO: 306 - DNA, 60 bp, Artificial Sequence
  Synthetic oligonucleotide probe
tgcgcatggtgatgatgacacactttttctccatactccaatcccaggagatacttgatc

SEQ ID NO: 307 - DNA, 60 bp, Artificial Sequence
  Synthetic oligonucleotide probe
tgactcaactgtcactgaacaggacatcagggtggaagaggagatataccaatgctgtaa

SEQ ID NO: 308 - DNA, 60 bp, Artificial Sequence
  Synthetic oligonucleotide probe
tatgacgtgatacagaagttgtcaattgagacgatgggtcctgcctatggattccaatac

SEQ ID NO: 309 - DNA, 60 bp, Artificial Sequence
  Synthetic oligonucleotide probe
gaagaaggttaccttcgatagactgcaggtgctcgacgaccattacaagactgcattaaa

SEQ ID NO: 310 - DNA, 60 bp, Artificial Sequence
  Synthetic oligonucleotide probe
tcataacctagtctattcaacgtcgtctagaagcgcttctcagcgtcagaagaaggttac

SEQ ID NO: 311 - DNA, 60 bp, Artificial Sequence
  Synthetic oligonucleotide probe
cattagggattatggaaaacagatggcaggtgatgattgtgtggcaagtagacaggatga

SEQ ID NO: 312 - DNA, 60 bp, Artificial Sequence
  Synthetic oligonucleotide probe
ctctggaaaggtgaaggggcagtagtaatacaagataatagtgacataaaagtagtgcca

SEQ ID NO: 313 - DNA, 60 bp, Artificial Sequence
  Synthetic oligonucleotide probe
aattttcgggtttattacagggacagcagaaatccactttggaaaggaccagcaaagctc

SEQ ID NO: 314 - DNA, 60 bp, Artificial Sequence
  Synthetic oligonucleotide probe
tggggggtacagtgcaggggaaagaatagtagacataatagcaacagacatacaaactaa

SEQ ID NO: 315 - DNA, 60 bp, Artificial Sequence
  Synthetic oligonucleotide probe
tcttaagacagcagtacaaatggcagtattcatccacaattttaaaagaaaaggggggat

SEQ ID NO: 316 - DNA, 60 bp, Artificial Sequence
  Synthetic oligonucleotide probe
ggaattccctacaatccccaaagtcaaggagtagtagaatctatgaataaagaattaaag

SEQ ID NO: 317 - DNA, 60 bp, Artificial Sequence
  Synthetic oligonucleotide probe
tggccagtaaaaacaatacatactgacaatggcagcaatttcaccggtgctacggttagg

SEQ ID NO: 318 - DNA, 60 bp, Artificial Sequence
  Synthetic oligonucleotide probe
gttattccagcagaaacagggcaggaaacagcatattttcttttaaaattagcaggaaga

SEQ ID NO: 319 - DNA, 60 bp, Artificial Sequence
  Synthetic oligonucleotide probe
ttagaaggaaaagttatcctggtagcagttcatgtagccagtggatatatagaagcagaa

SEQ ID NO: 320 - DNA, 60 bp, Artificial Sequence
  Synthetic oligonucleotide probe
gaagccatgcatggacaagtagactgtagtccaggaatatggcaactagattgtacacat

SEQ ID NO: 321 - DNA, 60 bp, Artificial Sequence
  Synthetic oligonucleotide probe
attttttagggaagatctggccttcctacaagggaaggccagggaattttcttcagagca

SEQ ID NO: 322 - DNA, 60 bp, Artificial Sequence
  Synthetic oligonucleotide probe
gctgttggaaatgtggaaaggaaggacaccaaatgaaagattgtactgagagacaggcta

SEQ ID NO: 323 - DNA, 60 bp, Artificial Sequence
  Synthetic oligonucleotide probe
aagattgttaagtgtttcaattgtggcaaagaagggcacacagccagaaattgcagggcc

SEQ ID NO: 324 - DNA, 60 bp, Artificial Sequence
  Synthetic oligonucleotide probe
agccaagtaacaaattcagctaccataatgatgcagagaggcaattttaggaaccaaaga

SEQ ID NO: 325 - DNA, 60 bp, Artificial Sequence
  Synthetic oligonucleotide probe
ccttgttggtccaaaatgcgaacccagattgtaagactattttaaaagcattgggaccag

SEQ ID NO: 326 - DNA, 60 bp, Artificial Sequence
  Synthetic oligonucleotide probe
tctataaaactctaagagccgagcaagcttcacaggaggtaaaaaattggatgacagaaa

SEQ ID NO: 327 - DNA, 60 bp, Artificial Sequence
  Synthetic oligonucleotide probe
taccagcattctggacataagacaaggaccaaaggaaccctttagagactatgtagaccg

SEQ ID NO: 328 - DNA, 60 bp, Artificial Sequence
  Synthetic oligonucleotide probe
gacaaataatccacctatcccagtaggagaaatttataaaagatggataatcctgggatt

SEQ ID NO: 329 - DNA, 60 bp, Artificial Sequence
  Synthetic oligonucleotide probe
accaaggggaagtgacatagcaggaactactagtacccttcaggaacaaataggatggat

SEQ ID NO: 330 - DNA, 60 bp, Artificial Sequence
  Synthetic oligonucleotide probe
ttaaaagagaccatcaatgaggaagctgcagaatgggatagagtgcatccagtgcatgca

SEQ ID NO: 331 - DNA, 60 bp, Artificial Sequence
  Synthetic oligonucleotide probe
ccaaaaaagataaagccacctttgcctagtgttacgaaactgacagaggatagatggaac

SEQ ID NO: 332 - DNA, 60 bp, Artificial Sequence
  Synthetic oligonucleotide probe
aggatctctacaatacttggcactagcagcattaataacaccaaaaaagataaagccacc

SEQ ID NO: 333 - DNA, 60 bp, Artificial Sequence
  Synthetic oligonucleotide probe
ttagccctaggtgtgaatatcaagcaggacataacaaggtaggatctctacaatacttgg

SEQ ID NO: 334 - DNA, 60 bp, Artificial Sequence
  Synthetic oligonucleotide probe
tcagactctgctataagaaaggccttattaggacacatagttagccctaggtgtgaatat

SEQ ID NO: 335 - DNA, 60 bp, Artificial Sequence
  Synthetic oligonucleotide probe
ctagcagaccaactaattcatctgtattactttgactgtttttcagactctgctataaga

SEQ ID NO: 336 - DNA, 60 bp, Artificial Sequence
  Synthetic oligonucleotide probe
atggaggaaaaagagatatagcacacaagtagaccctgaactagcagaccaactaattca

SEQ ID NO: 337 - DNA, 60 bp, Artificial Sequence
  Synthetic oligonucleotide probe
gagaaagagactggcatttgggtcagggagtctccatagaatggaggaaaaagagatata

SEQ ID NO: 338 - DNA, 60 bp, Artificial Sequence
  Synthetic oligonucleotide probe
gctagattggtaataacaacatattggggtctgcatacaggagaaagagactggcatttg

SEQ ID NO: 339 - DNA, 60 bp, Artificial Sequence
  Synthetic oligonucleotide probe
tccaagaataagttcagaagtacacatcccactaggggatgctagattggtaataacaac

SEQ ID NO: 340 - DNA, 60 bp, Artificial Sequence
  Synthetic oligonucleotide probe
ctaggggatggttttatagacatcactatgaaagccctcatccaagaataagttcagaag

SEQ ID NO: 341 - DNA, 60 bp, Artificial Sequence
  Synthetic oligonucleotide probe
ttcagaattgggtgtcgacatagcagaataggcgttactcgacagaggagagcaagaaat

SEQ ID NO: 342 - DNA, 60 bp, Artificial Sequence
  Synthetic oligonucleotide probe
acaactgctgtttatccattttcagaattgggtgtcgacatagcagaataggcgttactc

SEQ ID NO: 343 - DNA, 60 bp, Artificial Sequence
  Synthetic oligonucleotide probe
gccataataagaattctgcaacaactgctgtttatccattttcagaattgggtgtcgaca

SEQ ID NO: 344 - DNA, 60 bp, Artificial Sequence
  Synthetic oligonucleotide probe
atacttgggcaggagtggaagccataataagaattctgcaacaactgctgtttatccatt

SEQ ID NO: 345 - DNA, 60 bp, Artificial Sequence
  Synthetic oligonucleotide probe
tatctatgaaacttatggggatacttgggcaggagtggaagccataataagaattctgca

SEQ ID NO: 346 - DNA, 60 bp, Artificial Sequence
  Synthetic oligonucleotide probe
atttggctccatggcttagggcaacatatctatgaaacttatggggatacttgggcagga

SEQ ID NO: 347 - DNA, 60 bp, Artificial Sequence
  Synthetic oligonucleotide probe
ctgttagacattttcctaggatttggctccatggcttagggcaacatatctatgaaactt

SEQ ID NO: 348 - DNA, 60 bp, Artificial Sequence
  Synthetic oligonucleotide probe
agaggagcttaagaatgaagctgttagacattttcctaggatttggctccatggcttagg

SEQ ID NO: 349 - DNA, 60 bp, Artificial Sequence
  Synthetic oligonucleotide probe
gaatggacactagagcttttagaggagcttaagaatgaagctgttagacattttcctagg

SEQ ID NO: 350 - DNA, 60 bp, Artificial Sequence
  Synthetic oligonucleotide probe
cacagagggagccacacaatgaatggacactagagcttttagaggagcttaagaatgaag

SEQ ID NO: 351 - DNA, 60 bp, Artificial Sequence
  Synthetic oligonucleotide probe
atagtgaatagagttaggcagggatattcaccattatcgtttcagacccacctcccaacc

SEQ ID NO: 352 - DNA, 60 bp, Artificial Sequence
  Synthetic oligonucleotide probe
ggaattagataaatgggcaagtttgtggaattggtttaacataacaaattggctgtggta

SEQ ID NO: 353 - DNA, 60 bp, Artificial Sequence
  Synthetic oligonucleotide probe
caagcttaatacactccttaattgaagaatcgcaaaaccagcaagaaaagaatgaacaag

SEQ ID NO: 354 - DNA, 60 bp, Artificial Sequence
  Synthetic oligonucleotide probe
tggaacagatttggaatcacacgacctggatggagtgggacagagaaattaacaattaca

SEQ ID NO: 355 - DNA, 60 bp, Artificial Sequence
  Synthetic oligonucleotide probe
ctggaaaactcatttgcaccactgctgtgccttggaatgctagttggagtaataaatctc

SEQ ID NO: 356 - DNA, 60 bp, Artificial Sequence
  Synthetic oligonucleotide probe
attattgtctggtatagtgcagcagcagaacaatttgctgagggctattgaggcgcaaca

SEQ ID NO: 357 - DNA, 60 bp, Artificial Sequence
  Synthetic oligonucleotide probe
aagagtggtgcagagagaaaaaagagcagtgggaataggagctttgttccttgggttctt

SEQ ID NO: 358 - DNA, 60 bp, Artificial Sequence
  Synthetic oligonucleotide probe
taatagcaacaatgagtccgagatcttcagacctggaggaggagatatgagggacaattg

SEQ ID NO: 359 - DNA, 60 bp, Artificial Sequence
  Synthetic oligonucleotide probe
cagtggacaaattagatgttcatcaaatattacagggctgctattaacaagagatggtgg

SEQ ID NO: 360 - DNA, 60 bp, Artificial Sequence
  Synthetic oligonucleotide probe
aataaaacaaattataaacatgtggcagaaagtaggaaaagcaatgtatgcccctcccat

SEQ ID NO: 361 - DNA, 60 bp, Artificial Sequence
  Synthetic oligonucleotide probe
ggaagccctcaaatattggtggaatctcctacagtattggagtcaggaactaaagaatag

SEQ ID NO: 362 - DNA, 60 bp, Artificial Sequence
  Synthetic oligonucleotide probe
ttcagctaccaccgcttgagagacttactcttgattgtaacgaggattgtggaacttctg

SEQ ID NO: 363 - DNA, 60 bp, Artificial Sequence
  Synthetic oligonucleotide probe
agaagaagaaggtggagagagagacagagacagatccattcgattagtgaacggatcctt

SEQ ID NO: 364 - DNA, 60 bp, Artificial Sequence; identical to SEQ ID NO: 351
  Synthetic oligonucleotide probe

SEQ ID NO: 365 - DNA, 60 bp, Artificial Sequence; identical to SEQ ID NO: 352
  Synthetic oligonucleotide probe

SEQ ID NO: 366 - DNA, 60 bp, Artificial Sequence; identical to SEQ ID NO: 353
  Synthetic oligonucleotide probe

SEQ ID NO: 367 - DNA, 60 bp, Artificial Sequence; identical to SEQ ID NO: 354
  Synthetic oligonucleotide probe

SEQ ID NO: 368 - DNA, 60 bp, Artificial Sequence; identical to SEQ ID NO: 355
  Synthetic oligonucleotide probe

SEQ ID NO: 369 - DNA, 60 bp, Artificial Sequence; identical to SEQ ID NO: 356
  Synthetic oligonucleotide probe

SEQ ID NO: 370 - DNA, 60 bp, Artificial Sequence; identical to SEQ ID NO: 357
  Synthetic oligonucleotide probe

SEQ ID NO: 371 - DNA, 60 bp, Artificial Sequence
  Synthetic oligonucleotide probe
ctaatagaaagagcagaagacagtggcaatgagagtgaaggagaaatatcagcacttgtg

SEQ ID NO: 372 - DNA, 60 bp, Artificial Sequence
  Synthetic oligonucleotide probe
acttgtggagatgggggtggagatggggcaccatgctccttgggatgttgatgatctgta

SEQ ID NO: 373 - DNA, 60 bp, Artificial Sequence
  Synthetic oligonucleotide probe
cacttgtggagatgggggtggagatggggcaccatgctccttgggatgttgatgatctgt

SEQ ID NO: 374 - DNA, 60 bp, Artificial Sequence
  Synthetic oligonucleotide probe
agcacttgtggagatgggggtggagatggggcaccatgctccttgggatgttgatgatct

SEQ ID NO: 375 - DNA, 60 bp, Artificial Sequence
  Synthetic oligonucleotide probe
tcagcacttgtggagatgggggtggagatggggcaccatgctccttgggatgttgatgat

SEQ ID NO: 376 - DNA, 60 bp, Artificial Sequence
  Synthetic oligonucleotide probe
atcagcacttgtggagatgggggtggagatggggcaccatgctccttgggatgttgatga

SEQ ID NO: 377 - DNA, 60 bp, Artificial Sequence
  Synthetic oligonucleotide probe
tatcagcacttgtggagatgggggtggagatggggcaccatgctccttgggatgttgatg

SEQ ID NO: 378 - DNA, 60 bp, Artificial Sequence
  Synthetic oligonucleotide probe
atatcagcacttgtggagatgggggtggagatggggcaccatgctccttgggatgttgat

SEQ ID NO: 379 - DNA, 60 bp, Artificial Sequence
  Synthetic oligonucleotide probe
aatatcagcacttgtggagatgggggtggagatggggcaccatgctccttgggatgttga

SEQ ID NO: 380 - DNA, 60 bp, Artificial Sequence
  Synthetic oligonucleotide probe
aaatatcagcacttgtggagatgggggtggagatggggcaccatgctccttgggatgttg

SEQ ID NO: 381 - DNA, 60 bp, Artificial Sequence
  Synthetic oligonucleotide probe
acaattattgtctggtatagtgcagcagcagaacaatttgctgagggctattgaggcgca

SEQ ID NO: 382 - DNA, 60 bp, Artificial Sequence; identical to SEQ ID NO: 357
  Synthetic oligonucleotide probe

SEQ ID NO: 383 - DNA, 60 bp, Artificial Sequence
  Synthetic oligonucleotide probe
tagtaaaaattgaaccattaggagtagcacccaccaaggcaaagagaagagtggtgcaga

SEQ ID NO: 384 - DNA, 60 bp, Artificial Sequence
  Synthetic oligonucleotide probe
ttaacaagagatggtggtaatagcaacaatgagtccgagatcttcagacctggaggagga

SEQ ID NO: 385 - DNA, 60 bp, Artificial Sequence
  Synthetic oligonucleotide probe
agatgttcatcaaatattacagggctgctattaacaagagatggtggtaatagcaacaat

SEQ ID NO: 386 - DNA, 60 bp, Artificial Sequence
  Synthetic oligonucleotide probe
atgtatgcccctcccatcagtggacaaattagatgttcatcaaatattacagggctgcta

SEQ ID NO: 387 - DNA, 60 bp, Artificial Sequence
  Synthetic oligonucleotide probe
ataaacatgtggcagaaagtaggaaaagcaatgtatgcccctcccatcagtggacaaatt

SEQ ID NO: 388 - DNA, 60 bp, Artificial Sequence
  Synthetic oligonucleotide probe
atcaccctcccatgcagaataaaacaaattataaacatgtggcagaaagtaggaaaagca

SEQ ID NO: 389 - DNA, 60 bp, Artificial Sequence
  Synthetic oligonucleotide probe
gggtcaaataacactgaaggaagtgacacaatcaccctcccatgcagaataaaacaaatt

SEQ ID NO: 390 - DNA, 60 bp, Artificial Sequence
  Synthetic oligonucleotide probe
acttggtttaatagtacttggagtactgaagggtcaaataacactgaaggaagtgacaca

SEQ ID NO: 391 - DNA, 60 bp, Artificial Sequence
  Synthetic oligonucleotide probe
ttgagccagataagatagaagaggccaataaaggagagaacaccagcttgttacaccctg

SEQ ID NO: 392 - DNA, 60 bp, Artificial Sequence
  Synthetic oligonucleotide probe
gtgctacaagctagtaccagttgagccagataagatagaagaggccaataaaggagagaa

SEQ ID NO: 393 - DNA, 60 bp, Artificial Sequence
  Synthetic oligonucleotide probe
atatccactgacctttggatggtgctacaagctagtaccagttgagccagataagataga

SEQ ID NO: 394 - DNA, 60 bp, Artificial Sequence
  Synthetic oligonucleotide probe
gatatccttgatctgtggatctaccacacacaaggctacttccctgattagcagaactac

SEQ ID NO: 395 - DNA, 60 bp, Artificial Sequence
  Synthetic oligonucleotide probe
ttcactcccaaagaagacaagatatccttgatctgtggatctaccacacacaaggctact

SEQ ID NO: 396 - DNA, 60 bp, Artificial Sequence
  Synthetic oligonucleotide probe
aaagaaaaggggggactggaagggctaattcactcccaaagaagacaagatatccttgat

SEQ ID NO: 397 - DNA, 60 bp, Artificial Sequence
  Synthetic oligonucleotide probe
tagatcttagccactttttaaaagaaaaggggggactggaagggctaattcactcccaaa

SEQ ID NO: 398 - DNA, 60 bp, Artificial Sequence
  Synthetic oligonucleotide probe
aatgacttacaaggcagctgtagatcttagccactttttaaaagaaaaggggggactgga

SEQ ID NO: 399 - DNA, 60 bp, Artificial Sequence
  Synthetic oligonucleotide probe
cctcaggtacctttaagaccaatgacttacaaggcagctgtagatcttagccacttttta

SEQ ID NO: 400 - DNA, 60 bp, Artificial Sequence
  Synthetic oligonucleotide probe
agacctggaaaaacatggagcaatcacaagtagcaatacagcagctaccaatgctgcttg

SEQ ID NO: 401 - DNA, 60 bp, Artificial Sequence
  Synthetic oligonucleotide probe
ctcttcaataaagctgccagttagaagcaagttaagtgtgtgttcccatctctcctagtc

SEQ ID NO: 402 - DNA, 60 bp, Artificial Sequence
  Synthetic oligonucleotide probe
tcatacttactgtataaatgtacccgcttcttgcattgtattcagtcgctctgcggagag

SEQ ID NO: 403 - DNA, 60 bp, Artificial Sequence
  Synthetic oligonucleotide probe
gaataacaggaacaaccatacttggtcaaggcaggaagtagctactaagaaacagctgag

SEQ ID NO: 404 - DNA, 60 bp, Artificial Sequence
  Synthetic oligonucleotide probe
aaactgaaagcaagagggataccatatagtgaataacaggaacaaccatacttggtcaag

SEQ ID NO: 405 - DNA, 60 bp, Artificial Sequence
  Synthetic oligonucleotide probe
tcaggattgccagagaaagaatggaaggcaaaactgaaagcaagagggataccatatagt

SEQ ID NO: 406 - DNA, 60 bp, Artificial Sequence
  Synthetic oligonucleotide probe
acaaacaagcagacatgatgatgagcatggggagacattagtgtggcagtttgactccat

SEQ ID NO: 407 - DNA, 60 bp, Artificial Sequence
  Synthetic oligonucleotide probe
aagctagtatcagtagaactctcacaagaggcagaggaagatgaggccaactgcttagta

SEQ ID NO: 408 - DNA, 60 bp, Artificial Sequence
  Synthetic oligonucleotide probe
gataataccagattggcagaattatactcatgggccaggagtaaggtacccaatgtactt

SEQ ID NO: 409 - DNA, 60 bp, Artificial Sequence
  Synthetic oligonucleotide probe
cctagacatatacctagaaaaagaggaagggataataccagattggcagaattatactca

SEQ ID NO: 410 - DNA, 60 bp, Artificial Sequence
  Synthetic oligonucleotide probe
gatgttttacagtaggaggagacatagaatcctagacatatacctagaaaaagaggaagg

SEQ ID NO: 411 - DNA, 60 bp, Artificial Sequence
  Synthetic oligonucleotide probe
atttgcagcagcccaacaaagaaaggcaattaggtattggaactgtggaaaggagggaca

SEQ ID NO: 412 - DNA, 60 bp, Artificial Sequence
  Synthetic oligonucleotide probe
agactgcaagttagtactaaaaggactggggatgaatcccaccctagaagagatgctaac

SEQ ID NO: 413 - DNA, 60 bp, Artificial Sequence
  Synthetic oligonucleotide probe
aacagacccagcagtaaaaaattggatgacccaaacgctgctaatacagaatgccaaccc

SEQ ID NO: 414 - DNA, 60 bp, Artificial Sequence
  Synthetic oligonucleotide probe
accaaaagaaccgttccaaagctatgtagacaggttctacaaaagcttgagggcagaaca

SEQ ID NO: 415 - DNA, 60 bp, Artificial Sequence
  Synthetic oligonucleotide probe
agggctgcaaaagtgtgtcagaaagtacaacccaactaacatcttagacataaaacaggg

SEQ ID NO: 416 - DNA, 60 bp, Artificial Sequence
  Synthetic oligonucleotide probe
gatgtataggccacaaaatcccgtaccggtagggaacatctacagaagatggatccaaat

SEQ ID NO: 417 - DNA, 60 bp, Artificial Sequence
  Synthetic oligonucleotide probe
aatcagagagattattaatgaagaagcagcagactgggattcgcagcacccaataccagg

SEQ ID NO: 418 - DNA, 60 bp, Artificial Sequence
  Synthetic oligonucleotide probe
gccctatgatattaatcaaatgcttaattgtgtgggcgatcaccaagcagctatgcaaat

SEQ ID NO: 419 - DNA, 60 bp, Artificial Sequence
  Synthetic oligonucleotide probe
taaaattagtggaggaaaagaagttcggggcagaagtagtgccaggatttcaggcactct

SEQ ID NO: 420 - DNA, 60 bp, Artificial Sequence
  Synthetic oligonucleotide probe
gaaaatgccaaatacaagtagaccaacagcaccacctagtgggaaaagaggaaactaccc

SEQ ID NO: 421 - DNA, 60 bp, Artificial Sequence
  Synthetic oligonucleotide probe
gtatacagaaaagttctggacagatgttaccccagactgtgcagacatcctaatacatag

SEQ ID NO: 422 - DNA, 60 bp, Artificial Sequence
  Synthetic oligonucleotide probe
atattggaacctaacaccagaaaaaggatggctctcctctcatgcagtaagattaacctg

SEQ ID NO: 423 - DNA, 60 bp, Artificial Sequence
  Synthetic oligonucleotide probe
gtggacttgcagcagggtaatattcccactacaaggaaaaagtcatctagaaatacaggc

SEQ ID NO: 424 - DNA, 60 bp, Artificial Sequence
  Synthetic oligonucleotide probe
atgcccttgtcaagtacctgaaatacagaacaaaagacctagaggaggtgcgctatgttc

SEQ ID NO: 425 - DNA, 60 bp, Artificial Sequence
  Synthetic oligonucleotide probe
cagacataaaagtagtaccaagaaggaaggccaagattatcagggactatggaggaagac

SEQ ID NO: 426 - DNA, 60 bp, Artificial Sequence
  Synthetic oligonucleotide probe
aatttccaggtctattacagagaaggcagagatcagctgtggaaaggacctggtgaacta

SEQ ID NO: 427 - DNA, 60 bp, Artificial Sequence
  Synthetic oligonucleotide probe
cagcagaaagactaatcaacatgattaccacagaacaagaaatacaattcctccaaagaa

SEQ ID NO: 428 - DNA, 60 bp, Artificial Sequence
  Synthetic oligonucleotide probe
tactgatggcagttcattgcatgaattttaaaagaaggggaggaataggggatatgaccc

SEQ ID NO: 429 - DNA, 60 bp, Artificial Sequence
  Synthetic oligonucleotide probe
ccagggagtagtagaagcaatgaatcaccacctaaagaatcagataagtagaattagaga

SEQ ID NO: 430 - DNA, 60 bp, Artificial Sequence
  Synthetic oligonucleotide probe
agatggtggcatggtgggtaggtatagaacaatcctttggagtaccttacaacccacaaa

SEQ ID NO: 431 - DNA, 60 bp, Artificial Sequence
  Synthetic oligonucleotide probe
cacttcaatacctagccctagtagtagtacaacaaaatgacagaccccagagaaagggta

SEQ ID NO: 432 - DNA, 60 bp, Artificial Sequence
  Synthetic oligonucleotide probe
aagttattgtcctgctgcaactatccccaagctcataaagcacaggtaccatcacttcaa

SEQ ID NO: 433 - DNA, 60 bp, Artificial Sequence
  Synthetic oligonucleotide probe
atttctcttgctttacggcaggtgaagtaagaagagccatcagaggggaaaagttattgt

SEQ ID NO: 434 - DNA, 60 bp, Artificial Sequence
  Synthetic oligonucleotide probe
actgtgcagacatcctaatacatagcacttatttctcttgctttacggcaggtgaagtaa

SEQ ID NO: 435 - DNA, 60 bp, Artificial Sequence
  Synthetic oligonucleotide probe
acagaaaagttctggacagatgttaccccagactgtgcagacatcctaatacatagcact

SEQ ID NO: 436 - DNA, 60 bp, Artificial Sequence
  Synthetic oligonucleotide probe
tcctctcatgcagtaagattaacctggtatacagaaaagttctggacagatgttacccca

SEQ ID NO: 437 - DNA, 60 bp, Artificial Sequence
  Synthetic oligonucleotide probe
tggaacctaacaccagaaaaaggatggctctcctctcatgcagtaagattaacctggtat

SEQ ID NO: 438 - DNA, 60 bp, Artificial Sequence
  Synthetic oligonucleotide probe
aaggaaaaagtcatctagaaatacaggcatattggaacctaacaccagaaaaaggatggc

SEQ ID NO: 439 - DNA, 60 bp, Artificial Sequence
  Synthetic oligonucleotide probe
ggacttgcagcagggtaatattcccactacaaggaaaaagtcatctagaaatacaggcat

SEQ ID NO: 440 - DNA, 60 bp, Artificial Sequence
  Synthetic oligonucleotide probe
gagaaatggcatgcccttgtcaagtacctgaaatacagaacaaaagacctagaggaggtg

SEQ ID NO: 441 - DNA, 60 bp, Artificial Sequence
  Synthetic oligonucleotide probe
atgcaaaaagctatatttacacatttcaagagagggtgcacttgctggggggaggacatg

SEQ ID NO: 442 - DNA, 60 bp, Artificial Sequence
  Synthetic oligonucleotide probe
aatgcaaaaagctatatttacacatttcaagagagggtgcacttgctggggggaggacat

SEQ ID NO: 443 - DNA, 60 bp, Artificial Sequence
  Synthetic oligonucleotide probe
taatgcaaaaagctatatttacacatttcaagagagggtgcacttgctggggggaggaca

SEQ ID NO: 444 - DNA, 60 bp, Artificial Sequence
  Synthetic oligonucleotide probe
ctaatgcaaaaagctatatttacacatttcaagagagggtgcacttgctggggggaggac

SEQ ID NO: 445 - DNA, 60 bp, Artificial Sequence
  Synthetic oligonucleotide probe
cctaatgcaaaaagctatatttacacatttcaagagagggtgcacttgctggggggagga

SEQ ID NO: 446 - DNA, 60 bp, Artificial Sequence
  Synthetic oligonucleotide probe
tgcctaatgcaaaaagctatatttacacatttcaagagagggtgcacttgctggggggag

SEQ ID NO: 447 - DNA, 60 bp, Artificial Sequence
  Synthetic oligonucleotide probe
gtgcctaatgcaaaaagctatatttacacatttcaagagagggtgcacttgctgggggga

SEQ ID NO: 448 - DNA, 60 bp, Artificial Sequence
  Synthetic oligonucleotide probe
tgtgcctaatgcaaaaagctatatttacacatttcaagagagggtgcacttgctgggggg

SEQ ID NO: 449 - DNA, 60 bp, Artificial Sequence
  Synthetic oligonucleotide probe
ttgtgcctaatgcaaaaagctatatttacacatttcaagagagggtgcacttgctggggg

SEQ ID NO: 450 - DNA, 60 bp, Artificial Sequence
  Synthetic oligonucleotide probe
tttgtgcctaatgcaaaaagctatatttacacatttcaagagagggtgcacttgctgggg

SEQ ID NO: 451 - DNA, 60 bp, Artificial Sequence
  Synthetic oligonucleotide probe
atccataatagacatggagacacccttgaaggcgccagagagctcattaaaaccctacaa

SEQ ID NO: 452 - DNA, 60 bp, Artificial Sequence
  Synthetic oligonucleotide probe
tatccataatagacatggagacacccttgaaggcgccagagagctcattaaaaccctaca

SEQ ID NO: 453 - DNA, 60 bp, Artificial Sequence
  Synthetic oligonucleotide probe
atatccataatagacatggagacacccttgaaggcgccagagagctcattaaaaccctac

SEQ ID NO: 454 - DNA, 60 bp, Artificial Sequence
  Synthetic oligonucleotide probe
tatatccataatagacatggagacacccttgaaggcgccagagagctcattaaaacccta

SEQ ID NO: 455 - DNA, 60 bp, Artificial Sequence
  Synthetic oligonucleotide probe
ctatatccataatagacatggagacacccttgaaggcgccagagagctcattaaaaccct

SEQ ID NO: 456 - DNA, 60 bp, Artificial Sequence
  Synthetic oligonucleotide probe
actatatccataatagacatggagacacccttgaaggcgccagagagctcattaaaaccc

SEQ ID NO: 457 - DNA, 60 bp, Artificial Sequence
  Synthetic oligonucleotide probe
tactatatccataatagacatggagacacccttgaaggcgccagagagctcattaaaacc

SEQ ID NO: 458 - DNA, 60 bp, Artificial Sequence
  Synthetic oligonucleotide probe
ctactatatccataatagacatggagacacccttgaaggcgccagagagctcattaaaac

SEQ ID NO: 459 - DNA, 60 bp, Artificial Sequence
  Synthetic oligonucleotide probe
gctactatatccataatagacatggagacacccttgaaggcgccagagagctcattaaaa

SEQ ID NO: 460 - DNA, 60 bp, Artificial Sequence
  Synthetic oligonucleotide probe
ggctactatatccataatagacatggagacacccttgaaggcgccagagagctcattaaa

SEQ ID NO: 461 - DNA, 60 bp, Artificial Sequence
  Synthetic oligonucleotide probe
atgtagtgcaattgttaagtagatttagaaagggctataggcctgttttctcttcccccc

SEQ ID NO: 462 - DNA, 60 bp, Artificial Sequence
  Synthetic oligonucleotide probe
cctgggtcaagtatattcaatatggagtgcatatagtagtgggaataatagctttaagaa

SEQ ID NO: 463 - DNA, 60 bp, Artificial Sequence
  Synthetic oligonucleotide probe
ctacctagaggcaaatatcagtcaaagtttagaagaagcccaaattcaacaagaaaagaa

SEQ ID NO: 464 - DNA, 60 bp, Artificial Sequence
  Synthetic oligonucleotide probe
atgactctttatcgcctgactggaaaaatatgacatggcaggagtgggagaaacaagtcc

SEQ ID NO: 465 - DNA, 60 bp, Artificial Sequence
  Synthetic oligonucleotide probe
agaagtacctaaagcatcaggcacagctaaattcatggggatgtgcgtttagacaggtct

SEQ ID NO: 466 - DNA, 60 bp, Artificial Sequence
  Synthetic oligonucleotide probe
atagtgcagcaacagcaacagctgttggacgtagtcaagagacaacaagaaatgttgcga

SEQ ID NO: 467 - DNA, 60 bp, Artificial Sequence
  Synthetic oligonucleotide probe
aaataacaccaattggcttcgcacctacagatcagagaaggtactcctcaactccagtga

SEQ ID NO: 468 - DNA, 60 bp, Artificial Sequence
  Synthetic oligonucleotide probe
cctttagtgcagaagtggcagaactgtaccgattagaactgggagactacaaattaatag

SEQ ID NO: 469 - DNA, 60 bp, Artificial Sequence
  Synthetic oligonucleotide probe
ggcataaagtagggaaaaatgtatatttgcctcctagggaaggggagttggcctgtgaat

SEQ ID NO: 470 - DNA, 60 bp, Artificial Sequence
  Synthetic oligonucleotide probe
tagaagacaagaaccaaacacggcgcaactattgccatataaagcagataattaatacct

SEQ ID NO: 471 - DNA, 60 bp, Artificial Sequence
  Synthetic oligonucleotide probe
tactgactcgcctcttgatcgggctatacaacatctgcagagacttactatccaagaact

SEQ ID NO: 472 - DNA, 60 bp, Artificial Sequence; identical to SEQ ID NO: 461
  Synthetic oligonucleotide probe

SEQ ID NO: 473 - DNA, 60 bp, Artificial Sequence; identical to SEQ ID NO: 462
  Synthetic oligonucleotide probe

SEQ ID NO: 474 - DNA, 60 bp, Artificial Sequence; identical to SEQ ID NO: 463
  Synthetic oligonucleotide probe

SEQ ID NO: 475 - DNA, 60 bp, Artificial Sequence; identical to SEQ ID NO: 464
  Synthetic oligonucleotide probe

SEQ ID NO: 476 - DNA, 60 bp, Artificial Sequence; identical to SEQ ID NO: 465
  Synthetic oligonucleotide probe

SEQ ID NO: 477 - DNA, 60 bp, Artificial Sequence; identical to SEQ ID NO: 466
  Synthetic oligonucleotide probe

SEQ ID NO: 478 - DNA, 60 bp, Artificial Sequence; identical to SEQ ID NO: 467
  Synthetic oligonucleotide probe

SEQ ID NO: 479 - DNA, 60 bp, Artificial Sequence; identical to SEQ ID NO: 468
  Synthetic oligonucleotide probe

SEQ ID NO: 480 - DNA, 60 bp, Artificial Sequence; identical to SEQ ID NO: 469
  Synthetic oligonucleotide probe

SEQ ID NO: 481 - DNA, 60 bp, Artificial Sequence; identical to SEQ ID NO: 471
  Synthetic oligonucleotide probe

SEQ ID NO: 482 - DNA, 60 bp, Artificial Sequence; identical to SEQ ID NO: 461
  Synthetic oligonucleotide probe

SEQ ID NO: 483 - DNA, 60 bp, Artificial Sequence; identical to SEQ ID NO: 462
  Synthetic oligonucleotide probe

SEQ ID NO: 484 - DNA, 60 bp, Artificial Sequence; identical to SEQ ID NO: 463
  Synthetic oligonucleotide probe

SEQ ID NO: 485 - DNA, 60 bp, Artificial Sequence; identical to SEQ ID NO: 464
  Synthetic oligonucleotide probe

SEQ ID NO: 486 - DNA, 60 bp, Artificial Sequence; identical to SEQ ID NO: 465
  Synthetic oligonucleotide probe

SEQ ID NO: 487 - DNA, 60 bp, Artificial Sequence; identical to SEQ ID NO: 466
  Synthetic oligonucleotide probe

SEQ ID NO: 488 - DNA, 60 bp, Artificial Sequence; identical to SEQ ID NO: 467
  Synthetic oligonucleotide probe

SEQ ID NO: 489 - DNA, 60 bp, Artificial Sequence; identical to SEQ ID NO: 468
  Synthetic oligonucleotide probe

SEQ ID NO: 490 - DNA, 60 bp, Artificial Sequence; identical to SEQ ID NO: 469
  Synthetic oligonucleotide probe

SEQ ID NO: 491 - DNA, 60 bp, Artificial Sequence; identical to SEQ ID NO: 405
  Synthetic oligonucleotide probe

SEQ ID NO: 492 - DNA, 60 bp, Artificial Sequence; identical to SEQ ID NO: 406
  Synthetic oligonucleotide probe

SEQ ID NO: 493 - DNA, 60 bp, Artificial Sequence; identical to SEQ ID NO: 407
  Synthetic oligonucleotide probe

SEQ ID NO: 494 - DNA, 60 bp, Artificial Sequence; identical to SEQ ID NO: 408
  Synthetic oligonucleotide probe

SEQ ID NO: 495 - DNA, 60 bp, Artificial Sequence; identical to SEQ ID NO: 409
  Synthetic oligonucleotide probe

SEQ ID NO: 496 - DNA, 60 bp, Artificial Sequence; identical to SEQ ID NO: 410
  Synthetic oligonucleotide probe

SEQ ID NO: 497 - DNA, 60 bp, Artificial Sequence
  Synthetic oligonucleotide probe
cacattttataaaagaaaaagggggactgcaagggatgttttacagtaggaggagacata

SEQ ID NO: 498 - DNA, 60 bp, Artificial Sequence
  Synthetic oligonucleotide probe
caccaagagtaccacggagagaaatgacctataaattggcaatagatatgtcacatttta

SEQ ID NO: 499 - DNA, 60 bp, Artificial Sequence
  Synthetic oligonucleotide probe
atgatgatgacctaataggagttcctgttacaccaagagtaccacggagagaaatgacct

SEQ ID NO: 500 - DNA, 60 bp, Artificial Sequence
  Synthetic oligonucleotide probe
ggcagcaaaatatggatgatgtagattctgatgatgatgacctaataggagttcctgtta

SEQ ID NO: 501 - DNA, 60 bp, Artificial Sequence; identical to SEQ ID NO: 401
  Synthetic oligonucleotide probe

SEQ ID NO: 502 - DNA, 60 bp, Artificial Sequence; identical to SEQ ID NO: 402
  Synthetic oligonucleotide probe

SEQ ID NO: 503 - DNA, 60 bp, Artificial Sequence; identical to SEQ ID NO: 403
  Synthetic oligonucleotide probe

SEQ ID NO: 504 - DNA, 60 bp, Artificial Sequence; identical to SEQ ID NO: 404
  Synthetic oligonucleotide probe

SEQ ID NO: 505 - DNA, 60 bp, Artificial Sequence; identical to SEQ ID NO: 405
  Synthetic oligonucleotide probe

SEQ ID NO: 506 - DNA, 60 bp, Artificial Sequence; identical to SEQ ID NO: 406
  Synthetic oligonucleotide probe

SEQ ID NO: 507 - DNA, 60 bp, Artificial Sequence; identical to SEQ ID NO: 407
  Synthetic oligonucleotide probe

SEQ ID NO: 508 - DNA, 60 bp, Artificial Sequence; identical to SEQ ID NO: 408
  Synthetic oligonucleotide probe

SEQ ID NO: 509 - DNA, 60 bp, Artificial Sequence; identical to SEQ ID NO: 409
  Synthetic oligonucleotide probe

SEQ ID NO: 510 - DNA, 60 bp, Artificial Sequence; identical to SEQ ID NO: 410
  Synthetic oligonucleotide probe

SEQ ID NO: 511 - DNA, 60 bp, Artificial Sequence
  Synthetic oligonucleotide probe
agaatgccaaaaattactacaggcccgagggcacactaatagccctctaggagatatgtt

SEQ ID NO: 512 - DNA, 60 bp, Artificial Sequence
  Synthetic oligonucleotide probe
aagaatgccaaaaattactacaggcccgagggcacactaatagccctctaggagatatgt

SEQ ID NO: 513 - DNA, 60 bp, Artificial Sequence
  Synthetic oligonucleotide probe
aaagaatgccaaaaattactacaggcccgagggcacactaatagccctctaggagatatg

SEQ ID NO: 514 - DNA, 60 bp, Artificial Sequence
  Synthetic oligonucleotide probe
caaagaatgccaaaaattactacaggcccgagggcacactaatagccctctaggagatat

SEQ ID NO: 515 - DNA, 60 bp, Artificial Sequence
  Synthetic oligonucleotide probe
acaaagaatgccaaaaattactacaggcccgagggcacactaatagccctctaggagata

SEQ ID NO: 516 - DNA, 60 bp, Artificial Sequence
  Synthetic oligonucleotide probe
aacaaagaatgccaaaaattactacaggcccgagggcacactaatagccctctaggagat

SEQ ID NO: 517 - DNA, 60 bp, Artificial Sequence
  Synthetic oligonucleotide probe
aaacaaagaatgccaaaaattactacaggcccgagggcacactaatagccctctaggaga

SEQ ID NO: 518 - DNA, 60 bp, Artificial Sequence
  Synthetic oligonucleotide probe
atgcaaacaaagaatgccaaaaattactacaggcccgagggcacactaatagccctctag

SEQ ID NO: 519 - DNA, 60 bp, Artificial Sequence
  Synthetic oligonucleotide probe
aatgcaaacaaagaatgccaaaaattactacaggcccgagggcacactaatagccctcta

SEQ ID NO: 520 - DNA, 60 bp, Artificial Sequence
  Synthetic oligonucleotide probe
taatgcaaacaaagaatgccaaaaattactacaggcccgagggcacactaatagccctct

SEQ ID NO: 521 - DNA, 60 bp, Artificial Sequence
  Synthetic oligonucleotide probe
aataacccagtattcccagttaaaaaagccaatggaacctggcgattcatccacgacctg

SEQ ID NO: 522 - DNA, 60 bp, Artificial Sequence
  Synthetic oligonucleotide probe
aaataacccagtattcccagttaaaaaagccaatggaacctggcgattcatccacgacct

SEQ ID NO: 523 - DNA, 60 bp, Artificial Sequence
  Synthetic oligonucleotide probe
gaaataacccagtattcccagttaaaaaagccaatggaacctggcgattcatccacgacc

SEQ ID NO: 524 - DNA, 60 bp, Artificial Sequence
  Synthetic oligonucleotide probe
ggaaataacccagtattcccagttaaaaaagccaatggaacctggcgattcatccacgac

SEQ ID NO: 525 - DNA, 60 bp, Artificial Sequence
  Synthetic oligonucleotide probe
aggaaataacccagtattcccagttaaaaaagccaatggaacctggcgattcatccacga

SEQ ID NO: 526 - DNA, 60 bp, Artificial Sequence
  Synthetic oligonucleotide probe
caggaaataacccagtattcccagttaaaaaagccaatggaacctggcgattcatccacg

SEQ ID NO: 527 - DNA, 60 bp, Artificial Sequence
  Synthetic oligonucleotide probe
ccaggaaataacccagtattcccagttaaaaaagccaatggaacctggcgattcatccac

SEQ ID NO: 528 - DNA, 60 bp, Artificial Sequence
  Synthetic oligonucleotide probe
gccaggaaataacccagtattcccagttaaaaaagccaatggaacctggcgattcatcca

SEQ ID NO: 529 - DNA, 60 bp, Artificial Sequence
  Synthetic oligonucleotide probe
atatcgaaccctacaccgggccaggaaataacccagtattcccagttaaaaaagccaatg

SEQ ID NO: 530 - DNA, 60 bp, Artificial Sequence
  Synthetic oligonucleotide probe
catatcgaaccctacaccgggccaggaaataacccagtattcccagttaaaaaagccaat

SEQ ID NO: 531 - DNA, 60 bp, Artificial Sequence
  Synthetic oligonucleotide probe
aacccattggtattatttcaagcttcctggtcttaatagccgccagtggaaaggaccaca

SEQ ID NO: 532 - DNA, 60 bp, Artificial Sequence
  Synthetic oligonucleotide probe
atggacaatcaaccacctaaatgtattaaccaactgccacaaaacccgatggcagcttca

SEQ ID NO: 533 - DNA, 60 bp, Artificial Sequence
  Synthetic oligonucleotide probe
atataagtactttactgacaaacccgacctacctatggataatgctctatccatagccct

SEQ ID NO: 534 - DNA, 60 bp, Artificial Sequence
  Synthetic oligonucleotide probe
acataaacacagacaatggccctgcctatatttcccaagacttcctcaatatgtgtacct

SEQ ID NO: 535 - DNA, 60 bp, Artificial Sequence
  Synthetic oligonucleotide probe
aaagaaacaagctcagaagctatttcctctttgctccaggccattgcctatctaggcaag

SEQ ID NO: 536 - DNA, 60 bp, Artificial Sequence
  Synthetic oligonucleotide probe
aaatacactgtatcgccttcatgtatgggtagacaccttttcaggagccatctcagctac

SEQ ID NO: 537 - DNA, 60 bp, Artificial Sequence
  Synthetic oligonucleotide probe
tcaacatatttctagactccaagtatctttatcattaccttcggacccttgccctaggca

SEQ ID NO: 538 - DNA, 60 bp, Artificial Sequence
  Synthetic oligonucleotide probe
tcccaggcagcctatattctctgggacaagcatatattgtcacaaagatcattccccctt

SEQ ID NO: 539 - DNA, 60 bp, Artificial Sequence
  Synthetic oligonucleotide probe
attggctcctgtgaaagcccttatgccagtgtttactctttcccctgtgatcataaacac

SEQ ID NO: 540 - DNA, 60 bp, Artificial Sequence
  Synthetic oligonucleotide probe
caaaaatttaggtgcccagactggagaactttggaacacttttcttaaaacaactgcccc

SEQ ID NO: 541 - DNA, 60 bp, Artificial Sequence
  Synthetic oligonucleotide probe
tctactttttaacgaaaaagaggcagatgacaatgaccatgagccccaaatatcccccgg

SEQ ID NO: 542 - DNA, 60 bp, Artificial Sequence
  Synthetic oligonucleotide probe
gtactcttcctttcataatttgcatctcctatttgaagaatacaccaacatccccatttc

SEQ ID NO: 543 - DNA, 60 bp, Artificial Sequence
  Synthetic oligonucleotide probe
atctttagtactacagtcctcctcctttatatttcacaaatttcaaaccaaggcctacca

SEQ ID NO: 544 - DNA, 60 bp, Artificial Sequence
  Synthetic oligonucleotide probe
tctataaaatttcccttaccacaggggccctaataattctacccgaggactgtttgccca

SEQ ID NO: 545 - DNA, 60 bp, Artificial Sequence
  Synthetic oligonucleotide probe
taaccatgcttattatcagcccacttcccagggtttggacagagtcttcttttcggatac

SEQ ID NO: 546 - DNA, 60 bp, Artificial Sequence
  Synthetic oligonucleotide probe
attactctcttataaaccctgagtcatccctgtaaaccaagcacacaattattgcaacca

SEQ ID NO: 547 - DNA, 60 bp, Artificial Sequence
  Synthetic oligonucleotide probe
cagtgctgttttctaaatattactaattcccatgtctcaatactacaagagagacccccc

SEQ ID NO: 548 - DNA, 60 bp, Artificial Sequence
  Synthetic oligonucleotide probe
aaccacaaaaatctgctcaaaattgcacagtatgctgcccagaacagacgaggccttgat

SEQ ID NO: 549 - DNA, 60 bp, Artificial Sequence
  Synthetic oligonucleotide probe
aagagcctcctacatgaggtggacaaagatatttcccaattaactcaagcaatagtcaaa

SEQ ID NO: 550 - DNA, 60 bp, Artificial Sequence
  Synthetic oligonucleotide probe
attatacttgcattgtctgtatcgatcgtgccagcctatccacttggcacgtcctatact

SEQ ID NO: 551 - DNA, 60 bp, Artificial Sequence; identical to SEQ ID NO: 541
  Synthetic oligonucleotide probe

SEQ ID NO: 552 - DNA, 60 bp, Artificial Sequence; identical to SEQ ID NO: 542
  Synthetic oligonucleotide probe

SEQ ID NO: 553 - DNA, 60 bp, Artificial Sequence; identical to SEQ ID NO: 543
  Synthetic oligonucleotide probe

SEQ ID NO: 554 - DNA, 60 bp, Artificial Sequence; identical to SEQ ID NO: 544
  Synthetic oligonucleotide probe

SEQ ID NO: 555 - DNA, 60 bp, Artificial Sequence; identical to SEQ ID NO: 545
  Synthetic oligonucleotide probe

SEQ ID NO: 556 - DNA, 60 bp, Artificial Sequence; identical to SEQ ID NO: 546
  Synthetic oligonucleotide probe

SEQ ID NO: 557 - DNA, 60 bp, Artificial Sequence; identical to SEQ ID NO: 547
  Synthetic oligonucleotide probe

SEQ ID NO: 558 - DNA, 60 bp, Artificial Sequence; identical to SEQ ID NO: 548
  Synthetic oligonucleotide probe

SEQ ID NO: 559 - DNA, 60 bp, Artificial Sequence; identical to SEQ ID NO: 549
  Synthetic oligonucleotide probe

SEQ ID NO: 560 - DNA, 60 bp, Artificial Sequence; identical to SEQ ID NO: 550
  Synthetic oligonucleotide probe

SEQ ID NO: 561 - DNA, 60 bp, Artificial Sequence
  Synthetic oligonucleotide probe
gaacagtgctgttttctaaatattactaattcccatgtctcaatactacaagagagaccc

SEQ ID NO: 562 - DNA, 60 bp, Artificial Sequence
  Synthetic oligonucleotide probe
cctgttctgggagcaaggaggattatgcaaagcattacaagaacagtgctgttttctaaa

SEQ ID NO: 563 - DNA, 60 bp, Artificial Sequence
  Synthetic oligonucleotide probe
tcaaaaaccacaaaaatctgctcaaaattgcacagtatgctgcccagaacagacgaggcc

SEQ ID NO: 564 - DNA, 60 bp, Artificial Sequence
  Synthetic oligonucleotide probe
gaggtggacaaagatatttcccaattaactcaagcaatagtcaaaaaccacaaaaatctg

SEQ ID NO: 565 - DNA, 60 bp, Artificial Sequence
  Synthetic oligonucleotide probe
ctaattatacttgcattgtctgtatcgatcgtgccagcctatccacttggcacgtcctat

SEQ ID NO: 566 - DNA, 60 bp, Artificial Sequence
  Synthetic oligonucleotide probe
atcaaaactcctgactcttgtccagttaaccctacaaagcactaattatacttgcattgt

SEQ ID NO: 567 - DNA, 60 bp, Artificial Sequence
  Synthetic oligonucleotide probe
ctccatttttcaaaatgcggtttttccttctcccttctagtcgacgctccaggatatgac

SEQ ID NO: 568 - DNA, 60 bp, Artificial Sequence
  Synthetic oligonucleotide probe
agcccctactggaaatttcagcaagatgtcaattttactcaagaagtttcacacctcaat

SEQ ID NO: 569 - DNA, 60 bp, Artificial Sequence
  Synthetic oligonucleotide probe
ttattcagcctcttattcagacccttgttccttaaaatgcccatacctagggtgccaatc

SEQ ID NO: 570 - DNA, 60 bp, Artificial Sequence
  Synthetic oligonucleotide probe
ctcattggatcaaaaagccaaaccgaaatggcggaggctattattcagcctcttattcag

SEQ ID NO: 571 - DNA, 60 bp, Artificial Sequence
  Synthetic oligonucleotide probe
tagtcaaaataaaagatgccgagtctataaaagcgcaaggacagttcaggaggtggctcg

SEQ ID NO: 572 - DNA, 60 bp, Artificial Sequence
  Synthetic oligonucleotide probe
ctagtcaaaataaaagatgccgagtctataaaagcgcaaggacagttcaggaggtggctc

SEQ ID NO: 573 - DNA, 60 bp, Artificial Sequence
  Synthetic oligonucleotide probe
cctagtcaaaataaaagatgccgagtctataaaagcgcaaggacagttcaggaggtggct

SEQ ID NO: 574 - DNA, 60 bp, Artificial Sequence
  Synthetic oligonucleotide probe
tgcctagtcaaaataaaagatgccgagtctataaaagcgcaaggacagttcaggaggtgg

SEQ ID NO: 575 - DNA, 60 bp, Artificial Sequence
  Synthetic oligonucleotide probe
ttgcctagtcaaaataaaagatgccgagtctataaaagcgcaaggacagttcaggaggtg

SEQ ID NO: 576 - DNA, 60 bp, Artificial Sequence
  Synthetic oligonucleotide probe
tttgcctagtcaaaataaaagatgccgagtctataaaagcgcaaggacagttcaggaggt

SEQ ID NO: 577 - DNA, 60 bp, Artificial Sequence
  Synthetic oligonucleotide probe
atttgcctagtcaaaataaaagatgccgagtctataaaagcgcaaggacagttcaggagg

SEQ ID NO: 578 - DNA, 60 bp, Artificial Sequence
  Synthetic oligonucleotide probe
aatttgcctagtcaaaataaaagatgccgagtctataaaagcgcaaggacagttcaggag

SEQ ID NO: 579 - DNA, 60 bp, Artificial Sequence
  Synthetic oligonucleotide probe
aaatttgcctagtcaaaataaaagatgccgagtctataaaagcgcaaggacagttcagga

SEQ ID NO: 580 - DNA, 60 bp, Artificial Sequence
  Synthetic oligonucleotide probe
taaaatttgcctagtcaaaataaaagatgccgagtctataaaagcgcaaggacagttcag

SEQ ID NO: 581 - DNA, 60 bp, Artificial Sequence
  Synthetic oligonucleotide probe
aggtcagaccgtctcacacaaacaatcccaagtaaaggctctgacgtctccccctttttt

SEQ ID NO: 582 - DNA, 60 bp, Artificial Sequence
  Synthetic oligonucleotide probe
aaggtcagaccgtctcacacaaacaatcccaagtaaaggctctgacgtctcccccttttt

SEQ ID NO: 583 - DNA, 60 bp, Artificial Sequence
  Synthetic oligonucleotide probe
aaaggtcagaccgtctcacacaaacaatcccaagtaaaggctctgacgtctccccctttt

SEQ ID NO: 584 - DNA, 60 bp, Artificial Sequence
  Synthetic oligonucleotide probe
caaaaggtcagaccgtctcacacaaacaatcccaagtaaaggctctgacgtctccccctt

SEQ ID NO: 585 - DNA, 60 bp, Artificial Sequence
  Synthetic oligonucleotide probe
gacccaaaaggtcagaccgtctcacacaaacaatcccaagtaaaggctctgacgtctccc

SEQ ID NO: 586 - DNA, 60 bp, Artificial Sequence
  Synthetic oligonucleotide probe
cgacccaaaaggtcagaccgtctcacacaaacaatcccaagtaaaggctctgacgtctcc

SEQ ID NO: 587 - DNA, 60 bp, Artificial Sequence
  Synthetic oligonucleotide probe
tcgacccaaaaggtcagaccgtctcacacaaacaatcccaagtaaaggctctgacgtctc

SEQ ID NO: 588 - DNA, 60 bp, Artificial Sequence
  Synthetic oligonucleotide probe
atcgacccaaaaggtcagaccgtctcacacaaacaatcccaagtaaaggctctgacgtct

SEQ ID NO: 589 - DNA, 60 bp, Artificial Sequence
  Synthetic oligonucleotide probe
catcgacccaaaaggtcagaccgtctcacacaaacaatcccaagtaaaggctctgacgtc

SEQ ID NO: 590 - DNA, 60 bp, Artificial Sequence
  Synthetic oligonucleotide probe
tcatcgacccaaaaggtcagaccgtctcacacaaacaatcccaagtaaaggctctgacgt

SEQ ID NO: 591 - DNA, 60 bp, Artificial Sequence; identical to SEQ ID NO: 571
  Synthetic oligonucleotide probe

SEQ ID NO: 592 - DNA, 60 bp, Artificial Sequence
  Synthetic oligonucleotide probe
tctctattttatttaataaagaagaggcggatgacaatggcgactagcctcccgagccag

SEQ ID NO: 593 - DNA, 60 bp, Artificial Sequence
  Synthetic oligonucleotide probe
tagtagttcagtcctccctattaatcttcgaaaaattcgaaaccaaagccttccatccct

SEQ ID NO: 594 - DNA, 60 bp, Artificial Sequence
  Synthetic oligonucleotide probe
actccatcttaacaaccccaggtctaatatggaccttcaatgacggctcaccaatgattt

SEQ ID NO: 595 - DNA, 60 bp, Artificial Sequence
  Synthetic oligonucleotide probe
agaagaacttctatacaaaatgttcctacacacagggacagtcatagtcctcccggagga

SEQ ID NO: 596 - DNA, 60 bp, Artificial Sequence
  Synthetic oligonucleotide probe
aaatcacacataattacaatcctgtctcctctcagcccatttcccaggatttggacagag

SEQ ID NO: 597 - DNA, 60 bp, Artificial Sequence
  Synthetic oligonucleotide probe
aggaaatccacataaccctgaagcaagtcacaaaacccatcaaaacccaggagtcctata

SEQ ID NO: 598 - DNA, 60 bp, Artificial Sequence
  Synthetic oligonucleotide probe
atcaacccagaaaccatgctataatagacctgctagcttctgcagcaaatcccctaggtt

SEQ ID NO: 599 - DNA, 60 bp, Artificial Sequence
  Synthetic oligonucleotide probe
atacaggagcaatgttgcttcctcaacatcagtaacactcatgtatccgtcctccaggaa

SEQ ID NO: 600 - DNA, 60 bp, Artificial Sequence
  Synthetic oligonucleotide probe
aatcatcaaaacatcctccgggttgcacagtatgcagcccaaaatagacgaggattagac

SEQ ID NO: 601 - DNA, 60 bp, Artificial Sequence
  Synthetic oligonucleotide probe
aatggttctattataaactccccggccttaccaatcagcggtggaaaggtccattgcaat

SEQ ID NO: 602 - DNA, 60 bp, Artificial Sequence
  Synthetic oligonucleotide probe
ttggactctcaatcagctaaatgtcatgaaccccagtggtaaaacccgatggcaaatcca

SEQ ID NO: 603 - DNA, 60 bp, Artificial Sequence
  Synthetic oligonucleotide probe
actaaataaatatctactagactgtcctaaccttcccctagacaatgccattcacaaagc

SEQ ID NO: 604 - DNA, 60 bp, Artificial Sequence
  Synthetic oligonucleotide probe
gaattccaggagttttgtacctcctatcgcatcaagcattctacccatataccatacaac

SEQ ID NO: 605 - DNA, 60 bp, Artificial Sequence
  Synthetic oligonucleotide probe
tctcctgtaaaaagaaagaaaccagctgtgagactatcagcgccgttcttcaggccattt

SEQ ID NO: 606 - DNA, 60 bp, Artificial Sequence
  Synthetic oligonucleotide probe
tgtacagacttgccatacctgtcaaaccatcaactcacaacatcatatgcctcgagggta

SEQ ID NO: 607 - DNA, 60 bp, Artificial Sequence
  Synthetic oligonucleotide probe
tagactctaaatatttaatcaaatacctacattccctcgccattggggccttcctcggca

SEQ ID NO: 608 - DNA, 60 bp, Artificial Sequence
  Synthetic oligonucleotide probe
gggtcacctactggcctgcaccatcttaactctagacaaatataccctacaacattatgg

SEQ ID NO: 609 - DNA, 60 bp, Artificial Sequence
  Synthetic oligonucleotide probe
aagtacatctggtacaacatctgtcatctttcaacccaagcaaaattggcccctggcttg

SEQ ID NO: 610 - DNA, 60 bp, Artificial Sequence
  Synthetic oligonucleotide probe
ttacaagttatcctaggagagatccagtgggtctctaaaggaacacccatccttcgcaaa

SEQ ID NO: 611 - DNA, 60 bp, Artificial Sequence
  Synthetic oligonucleotide probe
gtactcaaacgccaacaaagaatgccaaaaaatcttacaagcccgcggacacactaacag

SEQ ID NO: 612 - DNA, 60 bp, Artificial Sequence
  Synthetic oligonucleotide probe
agcgtactcaaacgccaacaaagaatgccaaaaaatcttacaagcccgcggacacactaa

SEQ ID NO: 613 - DNA, 60 bp, Artificial Sequence
  Synthetic oligonucleotide probe
tagcgtactcaaacgccaacaaagaatgccaaaaaatcttacaagcccgcggacacacta

SEQ ID NO: 614 - DNA, 60 bp, Artificial Sequence
  Synthetic oligonucleotide probe
atcttacgttccctagcgtactcaaacgccaacaaagaatgccaaaaaatcttacaagcc

SEQ ID NO: 615 - DNA, 60 bp, Artificial Sequence
  Synthetic oligonucleotide probe
catcttacgttccctagcgtactcaaacgccaacaaagaatgccaaaaaatcttacaagc

SEQ ID NO: 616 - DNA, 60 bp, Artificial Sequence
  Synthetic oligonucleotide probe
ccatcttacgttccctagcgtactcaaacgccaacaaagaatgccaaaaaatcttacaag

SEQ ID NO: 617 - DNA, 60 bp, Artificial Sequence
  Synthetic oligonucleotide probe
gagcccatcttacgttccctagcgtactcaaacgccaacaaagaatgccaaaaaatctta

SEQ ID NO: 618 - DNA, 60 bp, Artificial Sequence
  Synthetic oligonucleotide probe
agagcccatcttacgttccctagcgtactcaaacgccaacaaagaatgccaaaaaatctt

SEQ ID NO: 619 - DNA, 60 bp, Artificial Sequence
  Synthetic oligonucleotide probe
aagagcccatcttacgttccctagcgtactcaaacgccaacaaagaatgccaaaaaatct

SEQ ID NO: 620 - DNA, 60 bp, Artificial Sequence
  Synthetic oligonucleotide probe
aaagagcccatcttacgttccctagcgtactcaaacgccaacaaagaatgccaaaaaatc

SEQ ID NO: 621 - DNA, 60 bp, Artificial Sequence
  Synthetic oligonucleotide probe
tctaaaaaatcacacataattacaatcctgtctcctctcagcccatttcccaggatttgg

SEQ ID NO: 622 - DNA, 60 bp, Artificial Sequence
  Synthetic oligonucleotide probe
atgtcagactcgcctctccctggtctcctaacggcaatctcctaaaatagtctaaaaaat

SEQ ID NO: 623 - DNA, 60 bp, Artificial Sequence; identical to SEQ ID NO: 597
  Synthetic oligonucleotide probe

SEQ ID NO: 624 - DNA, 60 bp, Artificial Sequence
  Synthetic oligonucleotide probe
tattcccttatcaacccagaaaccatgctataatagacctgctagcttctgcagcaaatc

SEQ ID NO: 625 - DNA, 60 bp, Artificial Sequence
  Synthetic oligonucleotide probe
gtttgtgcaaggccatacaggagcaatgttgcttcctcaacatcagtaacactcatgtat

SEQ ID NO: 626 - DNA, 60 bp, Artificial Sequence
  Synthetic oligonucleotide probe
tcaaaaatcatcaaaacatcctccgggttgcacagtatgcagcccaaaatagacgaggat

SEQ ID NO: 627 - DNA, 60 bp, Artificial Sequence
  Synthetic oligonucleotide probe
gaggttgacaaagacatctcccaccttacccaggccatagtcaaaaatcatcaaaacatc

SEQ ID NO: 628 - DNA, 60 bp, Artificial Sequence
  Synthetic oligonucleotide probe
caaatttatccagctgaccttacagagcaccaattactcctgcatggtttgcgtggatag

SEQ ID NO: 629 - DNA, 60 bp, Artificial Sequence
  Synthetic oligonucleotide probe
ttcagatgtaaatttcacccaggaagtcagccaagtgtcccttcgactacacttctctaa

SEQ ID NO: 630 - DNA, 60 bp, Artificial Sequence
  Synthetic oligonucleotide probe
atacttattcccacattggataaaaaagccaaacagacagggcctagggtactactcgcc

SEQ ID NO: 631 - DNA, 60 bp, Artificial Sequence
  Synthetic oligonucleotide probe
accaacatccctgtctctattttatttaataaagaagaggcggatgacaatggcgactag

SEQ ID NO: 632 - DNA, 60 bp, Artificial Sequence; identical to SEQ ID NO: 593
  Synthetic oligonucleotide probe

SEQ ID NO: 633 - DNA, 60 bp, Artificial Sequence; identical to SEQ ID NO: 594
  Synthetic oligonucleotide probe

SEQ ID NO: 634 - DNA, 60 bp, Artificial Sequence; identical to SEQ ID NO: 595
  Synthetic oligonucleotide probe

SEQ ID NO: 635 - DNA, 60 bp, Artificial Sequence; identical to SEQ ID NO: 596
  Synthetic oligonucleotide probe

SEQ ID NO: 636 - DNA, 60 bp, Artificial Sequence; identical to SEQ ID NO: 597
  Synthetic oligonucleotide probe

SEQ ID NO: 637 - DNA, 60 bp, Artificial Sequence; identical to SEQ ID NO: 598
  Synthetic oligonucleotide probe

SEQ ID NO: 638 - DNA, 60 bp, Artificial Sequence; identical to SEQ ID NO: 599
  Synthetic oligonucleotide probe

SEQ ID NO: 639 - DNA, 60 bp, Artificial Sequence; identical to SEQ ID NO: 600
  Synthetic oligonucleotide probe

SEQ ID NO: 640 - DNA, 60 bp, Artificial Sequence
  Synthetic oligonucleotide probe
atttatccagctgaccttacagagcaccaattactcctgcatggtttgcgtggatagatc

SEQ ID NO: 641 - DNA, 60 bp, Artificial Sequence
  Synthetic oligonucleotide probe
cagcggttacaaaaccgacataaccagtattcccttatcaacccagaaaccatgctataa

SEQ ID NO: 642 - DNA, 60 bp, Artificial Sequence; identical to SEQ ID NO: 625
  Synthetic oligonucleotide probe

SEQ ID NO: 643 - DNA, 60 bp, Artificial Sequence; identical to SEQ ID NO: 626
  Synthetic oligonucleotide probe

SEQ ID NO: 644 - DNA, 60 bp, Artificial Sequence; identical to SEQ ID NO: 627
  Synthetic oligonucleotide probe

SEQ ID NO: 645 - DNA, 60 bp, Artificial Sequence; identical to SEQ ID NO: 628
  Synthetic oligonucleotide probe

SEQ ID NO: 646 - DNA, 60 bp, Artificial Sequence
  Synthetic oligonucleotide probe
cgtcctggacgaccaaaatactcaaatttatccagctgaccttacagagcaccaattact

SEQ ID NO: 647 - DNA, 60 bp, Artificial Sequence; identical to SEQ ID NO: 629
  Synthetic oligonucleotide probe

SEQ ID NO: 648 - DNA, 60 bp, Artificial Sequence
  Synthetic oligonucleotide probe
cagtccatcctggaagtttcattcagatgtaaatttcacccaggaagtcagccaagtgtc

SEQ ID NO: 649 - DNA, 60 bp, Artificial Sequence; identical to SEQ ID NO: 630
  Synthetic oligonucleotide probe

SEQ ID NO: 650 - DNA, 60 bp, Artificial Sequence
  Synthetic oligonucleotide probe
taatgttttcttcctacttttattcagtctcacacattttccactagcccagcagagccg

SEQ ID NO: 651 - DNA, 60 bp, Artificial Sequence; identical to SEQ ID NO: 571
  Synthetic oligonucleotide probe

SEQ ID NO: 652 - DNA, 60 bp, Artificial Sequence; identical to SEQ ID NO: 572
  Synthetic oligonucleotide probe

SEQ ID NO: 653 - DNA, 60 bp, Artificial Sequence; identical to SEQ ID NO: 573
  Synthetic oligonucleotide probe

SEQ ID NO: 654 - DNA, 60 bp, Artificial Sequence; identical to SEQ ID NO: 574
  Synthetic oligonucleotide probe

SEQ ID NO: 655 - DNA, 60 bp, Artificial Sequence; identical to SEQ ID NO: 575
  Synthetic oligonucleotide probe

SEQ ID NO: 656 - DNA, 60 bp, Artificial Sequence; identical to SEQ ID NO: 576
  Synthetic oligonucleotide probe

SEQ ID NO: 657 - DNA, 60 bp, Artificial Sequence; identical to SEQ ID NO: 577
  Synthetic oligonucleotide probe

SEQ ID NO: 658 - DNA, 60 bp, Artificial Sequence; identical to SEQ ID NO: 578
  Synthetic oligonucleotide probe

SEQ ID NO: 659 - DNA, 60 bp, Artificial Sequence; identical to SEQ ID NO: 579
  Synthetic oligonucleotide probe

SEQ ID NO: 660 - DNA, 60 bp, Artificial Sequence; identical to SEQ ID NO: 580
  Synthetic oligonucleotide probe

SEQ ID NO: 661 - DNA, 60 bp, Artificial Sequence
  Synthetic oligonucleotide probe
caaaacaaaagaaaagaggaggaaagaccggaattgcagtcatgattggcctgatcgcca

SEQ ID NO: 662 - DNA, 60 bp, Artificial Sequence
  Synthetic oligonucleotide probe
tcaaaacaaaagaaaagaggaggaaagaccggaattgcagtcatgattggcctgatcgcc

SEQ ID NO: 663 - DNA, 60 bp, Artificial Sequence
  Synthetic oligonucleotide probe
ctcaaaacaaaagaaaagaggaggaaagaccggaattgcagtcatgattggcctgatcgc

SEQ ID NO: 664 - DNA, 60 bp, Artificial Sequence
  Synthetic oligonucleotide probe
gctcaaaacaaaagaaaagaggaggaaagaccggaattgcagtcatgattggcctgatcg

SEQ ID NO: 665 - DNA, 60 bp, Artificial Sequence
  Synthetic oligonucleotide probe
agctcaaaacaaaagaaaagaggaggaaagaccggaattgcagtcatgattggcctgatc

SEQ ID NO: 666 - DNA, 60 bp, Artificial Sequence
  Synthetic oligonucleotide probe
gagctcaaaacaaaagaaaagaggaggaaagaccggaattgcagtcatgattggcctgat

SEQ ID NO: 667 - DNA, 60 bp, Artificial Sequence
  Synthetic oligonucleotide probe
aatcggcggagctcaaaacaaaagaaaagaggaggaaagaccggaattgcagtcatgatt

SEQ ID NO: 668 - DNA, 60 bp, Artificial Sequence
  Synthetic oligonucleotide probe
tatcaatcggcggagctcaaaacaaaagaaaagaggaggaaagaccggaattgcagtcat

SEQ ID NO: 669 - DNA, 60 bp, Artificial Sequence
  Synthetic oligonucleotide probe
ctatcaatcggcggagctcaaaacaaaagaaaagaggaggaaagaccggaattgcagtca

SEQ ID NO: 670 - DNA, 60 bp, Artificial Sequence
  Synthetic oligonucleotide probe
tgctatcaatcggcggagctcaaaacaaaagaaaagaggaggaaagaccggaattgcagt

SEQ ID NO: 671 - DNA, 60 bp, Artificial Sequence
  Synthetic oligonucleotide probe
aggtatttggtaaaaacagaatcatggatcttgaggaaccctggatatgccctggtggca

SEQ ID NO: 672 - DNA, 60 bp, Artificial Sequence
  Synthetic oligonucleotide probe
aaggtatttggtaaaaacagaatcatggatcttgaggaaccctggatatgccctggtggc

SEQ ID NO: 673 - DNA, 60 bp, Artificial Sequence
  Synthetic oligonucleotide probe
caaggtatttggtaaaaacagaatcatggatcttgaggaaccctggatatgccctggtgg

SEQ ID NO: 674 - DNA, 60 bp, Artificial Sequence
  Synthetic oligonucleotide probe
acaaggtatttggtaaaaacagaatcatggatcttgaggaaccctggatatgccctggtg

SEQ ID NO: 675 - DNA, 60 bp, Artificial Sequence
  Synthetic oligonucleotide probe
cacaaggtatttggtaaaaacagaatcatggatcttgaggaaccctggatatgccctggt

SEQ ID NO: 676 - DNA, 60 bp, Artificial Sequence
  Synthetic oligonucleotide probe
ccacaaggtatttggtaaaaacagaatcatggatcttgaggaaccctggatatgccctgg

SEQ ID NO: 677 - DNA, 60 bp, Artificial Sequence
  Synthetic oligonucleotide probe
gccacaaggtatttggtaaaaacagaatcatggatcttgaggaaccctggatatgccctg

SEQ ID NO: 678 - DNA, 60 bp, Artificial Sequence
  Synthetic oligonucleotide probe
ggccacaaggtatttggtaaaaacagaatcatggatcttgaggaaccctggatatgccct

SEQ ID NO: 679 - DNA, 60 bp, Artificial Sequence
  Synthetic oligonucleotide probe
aggccacaaggtatttggtaaaaacagaatcatggatcttgaggaaccctggatatgccc

SEQ ID NO: 680 - DNA, 60 bp, Artificial Sequence
  Synthetic oligonucleotide probe
aaggccacaaggtatttggtaaaaacagaatcatggatcttgaggaaccctggatatgcc

SEQ ID NO: 681 - DNA, 60 bp, Artificial Sequence
  Synthetic oligonucleotide probe
gaacaacagatcaatcaccattggcacaagtctggaagcagcattggcaaagcctttaca

SEQ ID NO: 682 - DNA, 60 bp, Artificial Sequence
  Synthetic oligonucleotide probe
aaattgcagttgaagggaacaacctatggcgtctgttcaaaggctttcaagtttcttggg

SEQ ID NO: 683 - DNA, 60 bp, Artificial Sequence
  Synthetic oligonucleotide probe
ggtcatttgaagtgtagagtgaagatggaaaaattgcagttgaagggaacaacctatggc

SEQ ID NO: 684 - DNA, 60 bp, Artificial Sequence
  Synthetic oligonucleotide probe
ttttcaagcaacactgtcaagttgacgtcgggtcatttgaagtgtagagtgaagatggaa

SEQ ID NO: 685 - DNA, 60 bp, Artificial Sequence
  Synthetic oligonucleotide probe
atcaagctttggctggagccattcctgtggaattttcaagcaacactgtcaagttgacgt

SEQ ID NO: 686 - DNA, 60 bp, Artificial Sequence
  Synthetic oligonucleotide probe
aatgcatactacgtgatgactgttggaacaaagacgttcttggtccatcgtgagtggttc

SEQ ID NO: 687 - DNA, 60 bp, Artificial Sequence
  Synthetic oligonucleotide probe
gaaagagaatatcaagtacgaagtggccatttttgtccatggaccaactactgtggagtc

SEQ ID NO: 688 - DNA, 60 bp, Artificial Sequence
  Synthetic oligonucleotide probe
ctctaccaaggcaataggaagaaccatcttgaaagagaatatcaagtacgaagtggccat

SEQ ID NO: 689 - DNA, 60 bp, Artificial Sequence
  Synthetic oligonucleotide probe
ctatttggcaaaggaagcattgacacatgcgccaaatttgcctgctctaccaaggcaata

SEQ ID NO: 690 - DNA, 60 bp, Artificial Sequence
  Synthetic oligonucleotide probe
cgtgactatcatgtctaaggacaagcctaccatcgatgtgaagatgatgaatatggaggc

SEQ ID NO: 691 - DNA, 60 bp, Artificial Sequence
  Synthetic oligonucleotide probe
aaactgacagcggctgttggtatggtatggagatcagaccacagagacatgatgaaaaga

SEQ ID NO: 692 - DNA, 60 bp, Artificial Sequence
  Synthetic oligonucleotide probe
tattggattgaaagcaggctcaatgatacgtggaagcttgaaagggcagttctgggtgaa

SEQ ID NO: 693 - DNA, 60 bp, Artificial Sequence
  Synthetic oligonucleotide probe
agaacaacttggcgatccacagtgacctgtcctattggattgaaagcaggctcaatgata

SEQ ID NO: 694 - DNA, 60 bp, Artificial Sequence
  Synthetic oligonucleotide probe
gagagcaacacaactgaatgtgactcgaagatcattggaacggctgtcaagaacaacttg

SEQ ID NO: 695 - DNA, 60 bp, Artificial Sequence
  Synthetic oligonucleotide probe
atgtccgactcagaatcgcgcttggaatagcttagaagtggaggattttggatttggtct

SEQ ID NO: 696 - DNA, 60 bp, Artificial Sequence
  Synthetic oligonucleotide probe
aaagagtattttatttgcaccagaactcgccaacaacacctttgtggttgatggtccgga

SEQ ID NO: 697 - DNA, 60 bp, Artificial Sequence
  Synthetic oligonucleotide probe
gaaaaattggaaattggctggaaggcctggggaaagagtattttatttgcaccagaactc

SEQ ID NO: 698 - DNA, 60 bp, Artificial Sequence
  Synthetic oligonucleotide probe
aagatcattcagaaagctcataaggaaggagtgtgcggtctacgatcagtttccagactg

SEQ ID NO: 699 - DNA, 60 bp, Artificial Sequence
  Synthetic oligonucleotide probe
aagtattaccctgaaacgccacaaggcctagccaagatcattcagaaagctcataaggaa

SEQ ID NO: 700 - DNA, 60 bp, Artificial Sequence
  Synthetic oligonucleotide probe
agtgttcatacacaatgatgtggaggcttggatggaccggtacaagtattaccctgaaac

SEQ ID NO: 701 - DNA, 60 bp, Artificial Sequence
  Synthetic oligonucleotide probe
caaaaaagaaaggagcaagtctgctatgcttggctctagcctcaacaggacttttcaacc

SEQ ID NO: 702 - DNA, 60 bp, Artificial Sequence
  Synthetic oligonucleotide probe
atgcttgaatctggatgtgtacaggatactgctgttgatggtcggaataggcagcttgat

SEQ ID NO: 703 - DNA, 60 bp, Artificial Sequence
  Synthetic oligonucleotide probe
tagcttggatgatactgagagccataacattcacaacgacatcaaacgtggttgttccgc

SEQ ID NO: 704 - DNA, 60 bp, Artificial Sequence
  Synthetic oligonucleotide probe
tgtgttgaattcactggcggtagcttggatgatactgagagccataacattcacaacgac

SEQ ID NO: 705 - DNA, 60 bp, Artificial Sequence
  Synthetic oligonucleotide probe
attttgttgatgttggcggctgttttctttcaaatggcttatcacgatgcccgccaaatt

SEQ ID NO: 706 - DNA, 60 bp, Artificial Sequence
  Synthetic oligonucleotide probe
gatggaccaaccaggagaacattttgttgatgttggcggctgttttctttcaaatggctt

SEQ ID NO: 707 - DNA, 60 bp, Artificial Sequence
  Synthetic oligonucleotide probe
tttatggtggcatcgtttctcaaagcgagatggaccaaccaggagaacattttgttgatg

SEQ ID NO: 708 - DNA, 60 bp, Artificial Sequence
  Synthetic oligonucleotide probe
gaccttcaagatacaaccagtgtttatggtggcatcgtttctcaaagcgagatggaccaa

SEQ ID NO: 709 - DNA, 60 bp, Artificial Sequence
  Synthetic oligonucleotide probe
tacttacactgatgtgttacgctatgtcatcttggtgggggcagctttcgcagaatctaa

SEQ ID NO: 710 - DNA, 60 bp, Artificial Sequence
  Synthetic oligonucleotide probe
gctatactgattgctctgctagtcctggtgtttgggggcattacttacactgatgtgtta

SEQ ID NO: 711 - DNA, 60 bp, Artificial Sequence
  Synthetic oligonucleotide probe
ccctgggcaatcttgccctcagtagttggattttggataactctccaatacacaaagaga

SEQ ID NO: 712 - DNA, 60 bp, Artificial Sequence
  Synthetic oligonucleotide probe
aaacttccagctcatgaatgatccaggagcaccttggaagatatggatgctcagaatggt

SEQ ID NO: 713 - DNA, 60 bp, Artificial Sequence
  Synthetic oligonucleotide probe
tggaaacttccagctcatgaatgatccaggagcaccttggaagatatggatgctcagaat

SEQ ID NO: 714 - DNA, 60 bp, Artificial Sequence
  Synthetic oligonucleotide probe
atggaaacttccagctcatgaatgatccaggagcaccttggaagatatggatgctcagaa

SEQ ID NO: 715 - DNA, 60 bp, Artificial Sequence
  Synthetic oligonucleotide probe
atgatggaaacttccagctcatgaatgatccaggagcaccttggaagatatggatgctca

SEQ ID NO: 716 - DNA, 60 bp, Artificial Sequence
  Synthetic oligonucleotide probe
tgatgatggaaacttccagctcatgaatgatccaggagcaccttggaagatatggatgct

SEQ ID NO: 717 - DNA, 60 bp, Artificial Sequence
  Synthetic oligonucleotide probe
atgatgatggaaacttccagctcatgaatgatccaggagcaccttggaagatatggatgc

SEQ ID NO: 718 - DNA, 60 bp, Artificial Sequence
  Synthetic oligonucleotide probe
gatgatgatggaaacttccagctcatgaatgatccaggagcaccttggaagatatggatg

SEQ ID NO: 719 - DNA, 60 bp, Artificial Sequence
  Synthetic oligonucleotide probe
tgatgatgatggaaacttccagctcatgaatgatccaggagcaccttggaagatatggat

SEQ ID NO: 720 - DNA, 60 bp, Artificial Sequence
  Synthetic oligonucleotide probe
ttgatgatgatggaaacttccagctcatgaatgatccaggagcaccttggaagatatgga

SEQ ID NO: 721 - DNA, 60 bp, Artificial Sequence
  Synthetic oligonucleotide probe
tagaagacaacaacgaagtggaagtcatcacgaagcttggtgaaaggaagattctgaggc

SEQ ID NO: 722 - DNA, 60 bp, Artificial Sequence
  Synthetic oligonucleotide probe
agaaaaaactttctggaactgttgaggactgcagatctgccagtttggctggcttacaag

SEQ ID NO: 723 - DNA, 60 bp, Artificial Sequence
  Synthetic oligonucleotide probe
actgatcgctcaattctaccaaccagagcgtgagaaggtatataccatggatggggaata

SEQ ID NO: 724 - DNA, 60 bp, Artificial Sequence
  Synthetic oligonucleotide probe
ttatcacaacagacatatctgaaatgggggctaacttcaaggcgagcagggtgattgaca

SEQ ID NO: 725 - DNA, 60 bp, Artificial Sequence
  Synthetic oligonucleotide probe
tgaacagaaagtcgtacgagacggagtacccaaaatgtaagaacgatgattgggactttg

SEQ ID NO: 726 - DNA, 60 bp, Artificial Sequence
  Synthetic oligonucleotide probe
tcaagatggggaatgagattgccctttgcctacaacgtgctggaaagaaagtagtccaat

SEQ ID NO: 727 - DNA, 60 bp, Artificial Sequence
  Synthetic oligonucleotide probe
aggcacttcagatccattcccagagtccaattcaccaatttccgacttacagactgagat

SEQ ID NO: 728 - DNA, 60 bp, Artificial Sequence
  Synthetic oligonucleotide probe
aatggaaatgagattgttgatgtcatgtgtcatgctaccctcacccacaggctgatgtct

SEQ ID NO: 729 - DNA, 60 bp, Artificial Sequence
  Synthetic oligonucleotide probe
aacaaggaggattctgccacagatcatcaaagaggccataaacagaagactgagaacagc

SEQ ID NO: 730 - DNA, 60 bp, Artificial Sequence
  Synthetic oligonucleotide probe
acggtgatgtgattgggctttatggcaatggagtcataatgcccaacggctcatacataa

SEQ ID NO: 731 - DNA, 60 bp, Artificial Sequence
  Synthetic oligonucleotide probe
attgccttgattgccttattgagtgtgatgaccatgggagtattcttcctcctcatgcag

SEQ ID NO: 732 - DNA, 60 bp, Artificial Sequence
  Synthetic oligonucleotide probe
aattgccttgattgccttattgagtgtgatgaccatgggagtattcttcctcctcatgca

SEQ ID NO: 733 - DNA, 60 bp, Artificial Sequence
  Synthetic oligonucleotide probe
caattgccttgattgccttattgagtgtgatgaccatgggagtattcttcctcctcatgc

SEQ ID NO: 734 - DNA, 60 bp, Artificial Sequence
  Synthetic oligonucleotide probe
acaattgccttgattgccttattgagtgtgatgaccatgggagtattcttcctcctcatg

SEQ ID NO: 735 - DNA, 60 bp, Artificial Sequence
  Synthetic oligonucleotide probe
gacaattgccttgattgccttattgagtgtgatgaccatgggagtattcttcctcctcat

SEQ ID NO: 736 - DNA, 60 bp, Artificial Sequence
  Synthetic oligonucleotide probe
agacaattgccttgattgccttattgagtgtgatgaccatgggagtattcttcctcctca

SEQ ID NO: 737 - DNA, 60 bp, Artificial Sequence
  Synthetic oligonucleotide probe
cagacaattgccttgattgccttattgagtgtgatgaccatgggagtattcttcctcctc

SEQ ID NO: 738 - DNA, 60 bp, Artificial Sequence
  Synthetic oligonucleotide probe
tcagacaattgccttgattgccttattgagtgtgatgaccatgggagtattcttcctcct

SEQ ID NO: 739 - DNA, 60 bp, Artificial Sequence
  Synthetic oligonucleotide probe
ttcagacaattgccttgattgccttattgagtgtgatgaccatgggagtattcttcctcc

SEQ ID NO: 740 - DNA, 60 bp, Artificial Sequence
  Synthetic oligonucleotide probe
cttcagacaattgccttgattgccttattgagtgtgatgaccatgggagtattcttcctc

SEQ ID NO: 741 - DNA, 60 bp, Artificial Sequence
  Synthetic oligonucleotide probe
ttgtcatgtctatccataacatggacactcataaagaacatggaaaaaccaggactaaaa

SEQ ID NO: 742 - DNA, 60 bp, Artificial Sequence
  Synthetic oligonucleotide probe
acatcatgcgtgggggttggttgtcatgtctatccataacatggacactcataaagaaca

SEQ ID NO: 743 - DNA, 60 bp, Artificial Sequence
  Synthetic oligonucleotide probe
tgcagaagaaagttggacagatcatgctgatcttggtgtctctagctgcagtagtagtga

SEQ ID NO: 744 - DNA, 60 bp, Artificial Sequence
  Synthetic oligonucleotide probe
agaattagagcgcaccacacccatcatgcagaagaaagttggacagatcatgctgatctt

SEQ ID NO: 745 - DNA, 60 bp, Artificial Sequence
  Synthetic oligonucleotide probe
cagattacatcaacacctcattgacctcaataaacgttcaggcaagtgcactattcacac

SEQ ID NO: 746 - DNA, 60 bp, Artificial Sequence
  Synthetic oligonucleotide probe
gctaaagcatttgatcacgtcagattacatcaacacctcattgacctcaataaacgttca

SEQ ID NO: 747 - DNA, 60 bp, Artificial Sequence
  Synthetic oligonucleotide probe
tgacaacagcggtcctcactccactgctaaagcatttgatcacgtcagattacatcaaca

SEQ ID NO: 748 - DNA, 60 bp, Artificial Sequence
  Synthetic oligonucleotide probe
gtttgggcaaagaattgaggtcaaggagaatttcagcatgggagagtttcttctggactt

SEQ ID NO: 749 - DNA, 60 bp, Artificial Sequence
  Synthetic oligonucleotide probe
aagagtgacataagcagtttgtttgggcaaagaattgaggtcaaggagaatttcagcatg

SEQ ID NO: 750 - DNA, 60 bp, Artificial Sequence
  Synthetic oligonucleotide probe
tgggttggctagataagaccaagagtgacataagcagtttgtttgggcaaagaattgagg

SEQ ID NO: 751 - DNA, 60 bp, Artificial Sequence
  Synthetic oligonucleotide probe
gactacatgagttcactaaagagatatgaagacacaactttggttgaggacacagtactg

SEQ ID NO: 752 - DNA, 60 bp, Artificial Sequence
  Synthetic oligonucleotide probe
gaaaacatccaggtggctatcaaccaagtcagagcaatcatcggagatgagaagtatgtg

SEQ ID NO: 753 - DNA, 60 bp, Artificial Sequence
  Synthetic oligonucleotide probe
aatggatggaagacaaaaccccagtggagaaatggagtgacgtcccatattcaggaaaac

SEQ ID NO: 754 - DNA, 60 bp, Artificial Sequence
  Synthetic oligonucleotide probe
ttgatcatgaaagatggaagaacactggtggttccatgccgaggacaggatgaattggta

SEQ ID NO: 755 - DNA, 60 bp, Artificial Sequence
  Synthetic oligonucleotide probe
ccgtcaactggatggtatgattggcagcaggttccattttgctcaaaccatttcactgaa

SEQ ID NO: 756 - DNA, 60 bp, Artificial Sequence
  Synthetic oligonucleotide probe
ttgcatttacaacatgatgggaaagagagagaaaaaacccggagagttcggaaaggccaa

SEQ ID NO: 757 - DNA, 60 bp, Artificial Sequence
  Synthetic oligonucleotide probe
aatcaatggaggagcgccagagaagcagttgaagatccaaaattttgggagatggtggat

SEQ ID NO: 758 - DNA, 60 bp, Artificial Sequence
  Synthetic oligonucleotide probe
gaggaattcataagaaaggtcaacagcaatgcagctttgggtgccatgtttgaagagcag

SEQ ID NO: 759 - DNA, 60 bp, Artificial Sequence
  Synthetic oligonucleotide probe
cctaggaagaatggaaaaaaggacctggaagggaccccaatacgaggaagatgtaaactt

SEQ ID NO: 760 - DNA, 60 bp, Artificial Sequence
  Synthetic oligonucleotide probe
acattgtcaccatgaagagtggagtggatgtgttctacagaccttctgagtgttgtgaca

SEQ ID NO: 761 - DNA, 60 bp, Artificial Sequence
  Synthetic oligonucleotide probe
aaagaactaggaactctgaccagtgccatcaaccgccggagcacaaaacaaaagaaaaga

SEQ ID NO: 762 - DNA, 60 bp, Artificial Sequence
  Synthetic oligonucleotide probe
agaaagaactaggaactctgaccagtgccatcaaccgccggagcacaaaacaaaagaaaa

SEQ ID NO: 763 - DNA, 60 bp, Artificial Sequence
  Synthetic oligonucleotide probe
aagaaagaactaggaactctgaccagtgccatcaaccgccggagcacaaaacaaaagaaa

SEQ ID NO: 764 - DNA, 60 bp, Artificial Sequence
  Synthetic oligonucleotide probe
tttcaagaaagaactaggaactctgaccagtgccatcaaccgccggagcacaaaacaaaa

SEQ ID NO: 765 - DNA, 60 bp, Artificial Sequence
  Synthetic oligonucleotide probe
atgaagcatctcttgagtttcaagaaagaactaggaactctgaccagtgccatcaaccgc

SEQ ID NO: 766 - DNA, 60 bp, Artificial Sequence
  Synthetic oligonucleotide probe
aatgaagcatctcttgagtttcaagaaagaactaggaactctgaccagtgccatcaaccg

SEQ ID NO: 767 - DNA, 60 bp, Artificial Sequence
  Synthetic oligonucleotide probe
caatgaagcatctcttgagtttcaagaaagaactaggaactctgaccagtgccatcaacc

SEQ ID NO: 768 - DNA, 60 bp, Artificial Sequence
  Synthetic oligonucleotide probe
gcaatgaagcatctcttgagtttcaagaaagaactaggaactctgaccagtgccatcaac

SEQ ID NO: 769 - DNA, 60 bp, Artificial Sequence
  Synthetic oligonucleotide probe
agcaatgaagcatctcttgagtttcaagaaagaactaggaactctgaccagtgccatcaa

SEQ ID NO: 770 - DNA, 60 bp, Artificial Sequence
  Synthetic oligonucleotide probe
cagcaatgaagcatctcttgagtttcaagaaagaactaggaactctgaccagtgccatca

SEQ ID NO: 771 - DNA, 60 bp, Artificial Sequence
  Synthetic oligonucleotide probe
tgtcattggatggatgctaggaagcaacacaatgcaacgcgtcgtgtttgccattctatt

SEQ ID NO: 772 - DNA, 60 bp, Artificial Sequence
  Synthetic oligonucleotide probe
tggacagcacaaaagccacgagatatctggtgaagacagaatcatggatactgagaaacc

SEQ ID NO: 773 - DNA, 60 bp, Artificial Sequence
  Synthetic oligonucleotide probe
ttggacagcacaaaagccacgagatatctggtgaagacagaatcatggatactgagaaac

SEQ ID NO: 774 - DNA, 60 bp, Artificial Sequence
  Synthetic oligonucleotide probe
gttggacagcacaaaagccacgagatatctggtgaagacagaatcatggatactgagaaa

SEQ ID NO: 775 - DNA, 60 bp, Artificial Sequence
  Synthetic oligonucleotide probe
ggttggacagcacaaaagccacgagatatctggtgaagacagaatcatggatactgagaa

SEQ ID NO: 776 - DNA, 60 bp, Artificial Sequence
  Synthetic oligonucleotide probe
tggttggacagcacaaaagccacgagatatctggtgaagacagaatcatggatactgaga

SEQ ID NO: 777 - DNA, 60 bp, Artificial Sequence
  Synthetic oligonucleotide probe
ttggttggacagcacaaaagccacgagatatctggtgaagacagaatcatggatactgag

SEQ ID NO: 778 - DNA, 60 bp, Artificial Sequence
  Synthetic oligonucleotide probe
cttggttggacagcacaaaagccacgagatatctggtgaagacagaatcatggatactga

SEQ ID NO: 779 - DNA, 60 bp, Artificial Sequence
  Synthetic oligonucleotide probe
agcttggttggacagcacaaaagccacgagatatctggtgaagacagaatcatggatact

SEQ ID NO: 780 - DNA, 60 bp, Artificial Sequence
  Synthetic oligonucleotide probe
agaaaggagcttggttggacagcacaaaagccacgagatatctggtgaagacagaatcat

SEQ ID NO: 781 - DNA, 60 bp, Artificial Sequence; identical to SEQ ID NO: 771
  Synthetic oligonucleotide probe

SEQ ID NO: 782 - DNA, 60 bp, Artificial Sequence; identical to SEQ ID NO: 772
  Synthetic oligonucleotide probe

SEQ ID NO: 783 - DNA, 60 bp, Artificial Sequence; identical to SEQ ID NO: 773
  Synthetic oligonucleotide probe

SEQ ID NO: 784 - DNA, 60 bp, Artificial Sequence; identical to SEQ ID NO: 774
  Synthetic oligonucleotide probe

SEQ ID NO: 785 - DNA, 60 bp, Artificial Sequence; identical to SEQ ID NO: 775
  Synthetic oligonucleotide probe

SEQ ID NO: 786 - DNA, 60 bp, Artificial Sequence; identical to SEQ ID NO: 776
  Synthetic oligonucleotide probe

SEQ ID NO: 787 - DNA, 60 bp, Artificial Sequence; identical to SEQ ID NO: 777
  Synthetic oligonucleotide probe

SEQ ID NO: 788 - DNA, 60 bp, Artificial Sequence; identical to SEQ ID NO: 778
  Synthetic oligonucleotide probe

SEQ ID NO: 789 - DNA, 60 bp, Artificial Sequence; identical to SEQ ID NO: 779
  Synthetic oligonucleotide probe

SEQ ID NO: 790 - DNA, 60 bp, Artificial Sequence; identical to SEQ ID NO: 780
  Synthetic oligonucleotide probe

SEQ ID NO: 791 - DNA, 60 bp, Artificial Sequence
  Synthetic oligonucleotide probe
atacaccaagtctttggaggagcttttagatcactctttggagggatgtcctggatcaca

SEQ ID NO: 792 - DNA, 60 bp, Artificial Sequence
  Synthetic oligonucleotide probe
aacaacatatggagtatgttcaaaagcgttcaaattcgctaggactcccgctgacactgg

SEQ ID NO: 793 - DNA, 60 bp, Artificial Sequence
  Synthetic oligonucleotide probe
aagcaacactgtgaagttgacatcaggacatctgaagtgtcgggtgaagatggagaagtt

SEQ ID NO: 794 - DNA, 60 bp, Artificial Sequence
  Synthetic oligonucleotide probe
aaacactgatggagtttgaagaacctcatgccaccaaacaatctgttgtggctctagggt

SEQ ID NO: 795 - DNA, 60 bp, Artificial Sequence
  Synthetic oligonucleotide probe
tatgtcagttggtgagaagtccttcctggttcaccgagaatggtttatggatctgaacct

SEQ ID NO: 796 - DNA, 60 bp, Artificial Sequence
  Synthetic oligonucleotide probe
aagattcagtataactccatcggcgccatcttacacgctaaagttgggtgagtatggtga

SEQ ID NO: 797 - DNA, 60 bp, Artificial Sequence
  Synthetic oligonucleotide probe
gaaaacatcaagtatgaggttgccatatttgtgcatggcccgacgaccgttgaatctcat

SEQ ID NO: 798 - DNA, 60 bp, Artificial Sequence
  Synthetic oligonucleotide probe
attgacacatgtgcgaagtttgcctgtacaaccaaagcaactggatggatcatccagaag

SEQ ID NO: 799 - DNA, 60 bp, Artificial Sequence
  Synthetic oligonucleotide probe
tgatgtcaaaatgatgaacatggaagcagccaacctcgcagatgtgcgcagttactgtta

SEQ ID NO: 800 - DNA, 60 bp, Artificial Sequence
  Synthetic oligonucleotide probe
tgatctggtactggaaggcgatagttgtgtgaccataatgtcaaaagacaagccaaccat

SEQ ID NO: 801 - DNA, 60 bp, Artificial Sequence
  Synthetic oligonucleotide probe
tttgactattgcccaggaacaacagtaactataagtgacagttgcgaacaccgtggacct

SEQ ID NO: 802 - DNA, 60 bp, Artificial Sequence
  Synthetic oligonucleotide probe
actttgactattgcccaggaacaacagtaactataagtgacagttgcgaacaccgtggac

SEQ ID NO: 803 - DNA, 60 bp, Artificial Sequence
  Synthetic oligonucleotide probe
gactttgactattgcccaggaacaacagtaactataagtgacagttgcgaacaccgtgga

SEQ ID NO: 804 - DNA, 60 bp, Artificial Sequence
  Synthetic oligonucleotide probe
tgactttgactattgcccaggaacaacagtaactataagtgacagttgcgaacaccgtgg

SEQ ID NO: 805 - DNA, 60 bp, Artificial Sequence
  Synthetic oligonucleotide probe
ttgactttgactattgcccaggaacaacagtaactataagtgacagttgcgaacaccgtg

SEQ ID NO: 806 - DNA, 60 bp, Artificial Sequence
  Synthetic oligonucleotide probe
attgactttgactattgcccaggaacaacagtaactataagtgacagttgcgaacaccgt

SEQ ID NO: 807 - DNA, 60 bp, Artificial Sequence
  Synthetic oligonucleotide probe
gattgactttgactattgcccaggaacaacagtaactataagtgacagttgcgaacaccg

SEQ ID NO: 808 - DNA, 60 bp, Artificial Sequence
  Synthetic oligonucleotide probe
agattgactttgactattgcccaggaacaacagtaactataagtgacagttgcgaacacc

SEQ ID NO: 809 - DNA, 60 bp, Artificial Sequence
  Synthetic oligonucleotide probe
gagattgactttgactattgcccaggaacaacagtaactataagtgacagttgcgaacac

SEQ ID NO: 810 - DNA, 60 bp, Artificial Sequence
  Synthetic oligonucleotide probe
cgagattgactttgactattgcccaggaacaacagtaactataagtgacagttgcgaaca

SEQ ID NO: 811 - DNA, 60 bp, Artificial Sequence
  Synthetic oligonucleotide probe
ctcatcaaagaaaaaaggagctctgcagcaaaaaagaaaggagcttgcctcatctgccta

SEQ ID NO: 812 - DNA, 60 bp, Artificial Sequence
  Synthetic oligonucleotide probe
tcatggttggagttggaagcctcatcaaagaaaaaaggagctctgcagcaaaaaagaaag

SEQ ID NO: 813 - DNA, 60 bp, Artificial Sequence
  Synthetic oligonucleotide probe
tgtgtacagaattttgctactcatggttggagttggaagcctcatcaaagaaaaaaggag

SEQ ID NO: 814 - DNA, 60 bp, Artificial Sequence
  Synthetic oligonucleotide probe
ttgaaatgcttaaaccttgatgtgtacagaattttgctactcatggttggagttggaagc

SEQ ID NO: 815 - DNA, 60 bp, Artificial Sequence
  Synthetic oligonucleotide probe
tggcccttttgacacctggattgaaatgcttaaaccttgatgtgtacagaattttgctac

SEQ ID NO: 816 - DNA, 60 bp, Artificial Sequence
  Synthetic oligonucleotide probe
actctctctccgttgcgtggatgattctcagagctataagcttcaccaacacttcaaatg

SEQ ID NO: 817 - DNA, 60 bp, Artificial Sequence
  Synthetic oligonucleotide probe
aatggcttactatgacgccaagaatgttctgtcatgggaagtgcctgacgttttgaactc

SEQ ID NO: 818 - DNA, 60 bp, Artificial Sequence
  Synthetic oligonucleotide probe
cttgcagctgctttcttccaaatggcttactatgacgccaagaatgttctgtcatgggaa

SEQ ID NO: 819 - DNA, 60 bp, Artificial Sequence
  Synthetic oligonucleotide probe
aagagagtattttgctcatgcttgcagctgctttcttccaaatggcttactatgacgcca

SEQ ID NO: 820 - DNA, 60 bp, Artificial Sequence
  Synthetic oligonucleotide probe
ctttttgaaggcaaggtggaccaaccaagagagtattttgctcatgcttgcagctgcttt

SEQ ID NO: 821 - DNA, 60 bp, Artificial Sequence
  Synthetic oligonucleotide probe
aaattttcaactgatgaatgaccccggggcaccatggaaaatttggatgcttaggatggc

SEQ ID NO: 822 - DNA, 60 bp, Artificial Sequence
  Synthetic oligonucleotide probe
gaaattttcaactgatgaatgaccccggggcaccatggaaaatttggatgcttaggatgg

SEQ ID NO: 823 - DNA, 60 bp, Artificial Sequence
  Synthetic oligonucleotide probe
ggaaattttcaactgatgaatgaccccggggcaccatggaaaatttggatgcttaggatg

SEQ ID NO: 824 - DNA, 60 bp, Artificial Sequence
  Synthetic oligonucleotide probe
tggaaattttcaactgatgaatgaccccggggcaccatggaaaatttggatgcttaggat

SEQ ID NO: 825 - DNA, 60 bp, Artificial Sequence
  Synthetic oligonucleotide probe
atggaaattttcaactgatgaatgaccccggggcaccatggaaaatttggatgcttagga

SEQ ID NO: 826 - DNA, 60 bp, Artificial Sequence
  Synthetic oligonucleotide probe
gatggaaattttcaactgatgaatgaccccggggcaccatggaaaatttggatgcttagg

SEQ ID NO: 827 - DNA, 60 bp, Artificial Sequence
  Synthetic oligonucleotide probe
tgatggaaattttcaactgatgaatgaccccggggcaccatggaaaatttggatgcttag

SEQ ID NO: 828 - DNA, 60 bp, Artificial Sequence
  Synthetic oligonucleotide probe
atgatggaaattttcaactgatgaatgaccccggggcaccatggaaaatttggatgctta

SEQ ID NO: 829 - DNA, 60 bp, Artificial Sequence
  Synthetic oligonucleotide probe
gatgatggaaattttcaactgatgaatgaccccggggcaccatggaaaatttggatgctt

SEQ ID NO: 830 - DNA, 60 bp, Artificial Sequence
  Synthetic oligonucleotide probe
tgatgatggaaattttcaactgatgaatgaccccggggcaccatggaaaatttggatgct

SEQ ID NO: 831 - DNA, 60 bp, Artificial Sequence
  Synthetic oligonucleotide probe
agagtgtactcagaccatcaagctctaaagtccttcaaagattttgcatcggggaaacga

SEQ ID NO: 832 - DNA, 60 bp, Artificial Sequence
  Synthetic oligonucleotide probe
aacaatgaagttgaagtcatcacgaagttgggtgagagaaagatcctaagacccaggtgg

SEQ ID NO: 833 - DNA, 60 bp, Artificial Sequence
  Synthetic oligonucleotide probe
atcataccatgaccggaaatggtgctttgatggacctcgaaccaacacgattcttgaaga

SEQ ID NO: 834 - DNA, 60 bp, Artificial Sequence
  Synthetic oligonucleotide probe
aacttccttgaattcctgagaacagctgatttaccagtctggctcgcttacaaagtggca

SEQ ID NO: 835 - DNA, 60 bp, Artificial Sequence
  Synthetic oligonucleotide probe
aaatgaggatgattccaactttgctcactggacagaggctcgcatcatgctagacaacat

SEQ ID NO: 836 - DNA, 60 bp, Artificial Sequence
  Synthetic oligonucleotide probe
ttttgtcatcaccacagacatatcagaaatgggagccaacttcaaggcgagcagagtgat

SEQ ID NO: 837 - DNA, 60 bp, Artificial Sequence
  Synthetic oligonucleotide probe
atccagctgaacagaaagtcctatgagacagagtaccccaagtgtaagaacgatgattgg

SEQ ID NO: 838 - DNA, 60 bp, Artificial Sequence
  Synthetic oligonucleotide probe
agaccgtttggtttgttccaagtgtgaaaatgggaaatgagattgccctctgtctgcaac

SEQ ID NO: 839 - DNA, 60 bp, Artificial Sequence
  Synthetic oligonucleotide probe
cagagatcccagacagagcctggaacactggatatgaatggataactgagtatgttggaa

SEQ ID NO: 840 - DNA, 60 bp, Artificial Sequence
  Synthetic oligonucleotide probe
tgatgtctccacacagagtccccaactacaacctgttcataatggatgaagcccatttca

SEQ ID NO: 841 - DNA, 60 bp, Artificial Sequence
  Synthetic oligonucleotide probe
ttctactcatgcaaaggaagggcattggtaagattggcttgggaggagtaatcttaggag

SEQ ID NO: 842 - DNA, 60 bp, Artificial Sequence
  Synthetic oligonucleotide probe
tttctactcatgcaaaggaagggcattggtaagattggcttgggaggagtaatcttagga

SEQ ID NO: 843 - DNA, 60 bp, Artificial Sequence
  Synthetic oligonucleotide probe
ttttctactcatgcaaaggaagggcattggtaagattggcttgggaggagtaatcttagg

SEQ ID NO: 844 - DNA, 60 bp, Artificial Sequence
  Synthetic oligonucleotide probe
tttttctactcatgcaaaggaagggcattggtaagattggcttgggaggagtaatcttag

SEQ ID NO: 845 - DNA, 60 bp, Artificial Sequence
  Synthetic oligonucleotide probe
ttttttctactcatgcaaaggaagggcattggtaagattggcttgggaggagtaatctta

SEQ ID NO: 846 - DNA, 60 bp, Artificial Sequence
  Synthetic oligonucleotide probe
gttttttctactcatgcaaaggaagggcattggtaagattggcttgggaggagtaatctt

SEQ ID NO: 847 - DNA, 60 bp, Artificial Sequence
  Synthetic oligonucleotide probe
tgttttttctactcatgcaaaggaagggcattggtaagattggcttgggaggagtaatct

SEQ ID NO: 848 - DNA, 60 bp, Artificial Sequence
  Synthetic oligonucleotide probe
gtgttttttctactcatgcaaaggaagggcattggtaagattggcttgggaggagtaatc

SEQ ID NO: 849 - DNA, 60 bp, Artificial Sequence
  Synthetic oligonucleotide probe
tgtgttttttctactcatgcaaaggaagggcattggtaagattggcttgggaggagtaat

SEQ ID NO: 850 - DNA, 60 bp, Artificial Sequence
  Synthetic oligonucleotide probe
gtgtgttttttctactcatgcaaaggaagggcattggtaagattggcttgggaggagtaa

SEQ ID NO: 851 - DNA, 60 bp, Artificial Sequence
  Synthetic oligonucleotide probe
aaagttggacagatcatattgatcttggtatcaatggccgcggtggtcgtcaatccatca

SEQ ID NO: 852 - DNA, 60 bp, Artificial Sequence
  Synthetic oligonucleotide probe
gaaaaaagttggacagatcatattgatcttggtatcaatggccgcggtggtcgtcaatcc

SEQ ID NO: 853 - DNA, 60 bp, Artificial Sequence
  Synthetic oligonucleotide probe
agaaaaaagttggacagatcatattgatcttggtatcaatggccgcggtggtcgtcaatc

SEQ ID NO: 854 - DNA, 60 bp, Artificial Sequence
  Synthetic oligonucleotide probe
cagaaaaaagttggacagatcatattgatcttggtatcaatggccgcggtggtcgtcaat

SEQ ID NO: 855 - DNA, 60 bp, Artificial Sequence
  Synthetic oligonucleotide probe
gcagaaaaaagttggacagatcatattgatcttggtatcaatggccgcggtggtcgtcaa

SEQ ID NO: 856 - DNA, 60 bp, Artificial Sequence
  Synthetic oligonucleotide probe
tgcagaaaaaagttggacagatcatattgatcttggtatcaatggccgcggtggtcgtca

SEQ ID NO: 857 - DNA, 60 bp, Artificial Sequence
  Synthetic oligonucleotide probe
atgcagaaaaaagttggacagatcatattgatcttggtatcaatggccgcggtggtcgtc

SEQ ID NO: 858 - DNA, 60 bp, Artificial Sequence
  Synthetic oligonucleotide probe
catgcagaaaaaagttggacagatcatattgatcttggtatcaatggccgcggtggtcgt

SEQ ID NO: 859 - DNA, 60 bp, Artificial Sequence
  Synthetic oligonucleotide probe
tcatgcagaaaaaagttggacagatcatattgatcttggtatcaatggccgcggtggtcg

SEQ ID NO: 860 - DNA, 60 bp, Artificial Sequence
  Synthetic oligonucleotide probe
gtcatgcagaaaaaagttggacagatcatattgatcttggtatcaatggccgcggtggtc

SEQ ID NO: 861 - DNA, 60 bp, Artificial Sequence
  Synthetic oligonucleotide probe
gattacatgagctccttgaggaggtatgaagacaccattgtagtggaggacactgttttg

SEQ ID NO: 862 - DNA, 60 bp, Artificial Sequence
  Synthetic oligonucleotide probe
gaaaatatccatgtggcaatcaatcaggtccgttcagtgattggagaagagaagtatgtg

SEQ ID NO: 863 - DNA, 60 bp, Artificial Sequence
  Synthetic oligonucleotide probe
aaacaccagttgagaggtggagtgatgttccatactctggaaagagagaggacatttggt

SEQ ID NO: 864 - DNA, 60 bp, Artificial Sequence
  Synthetic oligonucleotide probe
tatgactggcagcaggttccattctgttcaaaccatttcacggaactgatcatgaaggac

SEQ ID NO: 865 - DNA, 60 bp, Artificial Sequence
  Synthetic oligonucleotide probe
tacacttcctaaatgctatgtcaaaggtccgcaaagacatccaggaatggaaaccctcga

SEQ ID NO: 866 - DNA, 60 bp, Artificial Sequence
  Synthetic oligonucleotide probe
tgttgaaaaactgggaaaaggaaaaggccctaaggtcagaacctggctgtttgagaatgg

SEQ ID NO: 867 - DNA, 60 bp, Artificial Sequence
  Synthetic oligonucleotide probe
tacatcttgaaggaagttggaacaaagcctggaggaaaggtttacgctgatgataccgca

SEQ ID NO: 868 - DNA, 60 bp, Artificial Sequence
  Synthetic oligonucleotide probe
tgcatctacaacatgatgggaaagagagagaagaagcctggagagttcggcaaagctaaa

SEQ ID NO: 869 - DNA, 60 bp, Artificial Sequence
  Synthetic oligonucleotide probe
tgtttgaagaacagaaccaatggaagaacgcccgggaagctgtagaggatccaaagtttt

SEQ ID NO: 870 - DNA, 60 bp, Artificial Sequence
  Synthetic oligonucleotide probe
taagaaacccaggatgtgttcccgggaggaatttattggaaaagtcaacagtaatgccgc

SEQ ID NO: 871 - DNA, 60 bp, Artificial Sequence
  Synthetic oligonucleotide probe
tatatcagttgtggtaatgtccatggccacctttgcaagctccagatccaacttcgagaa

SEQ ID NO: 872 - DNA, 60 bp, Artificial Sequence
  Synthetic oligonucleotide probe
aacgaacagggctaattgatgagttggagaaagcggtatactctaggtatgaagtgcagg

SEQ ID NO: 873 - DNA, 60 bp, Artificial Sequence
  Synthetic oligonucleotide probe
taaaaaggctatttaaactgggcaaaccgctagcggcaggtgacgaacaagatgaggata

SEQ ID NO: 874 - DNA, 60 bp, Artificial Sequence
  Synthetic oligonucleotide probe
agaaagccccttacttttgtggagggtttatactgcacgatatcgtgacaggaacagctt

SEQ ID NO: 875 - DNA, 60 bp, Artificial Sequence
  Synthetic oligonucleotide probe
atgaattgatggcagccagatgcgccacttggatgaacatggaagtgaagatcatagatg

SEQ ID NO: 876 - DNA, 60 bp, Artificial Sequence
  Synthetic oligonucleotide probe
aaatctggtatgttcctaactctgttcgtcaacacactgctaaatatcaccatcgccagc

SEQ ID NO: 877 - DNA, 60 bp, Artificial Sequence
  Synthetic oligonucleotide probe
actgctttaatgctgttagaggatttaggggtggatcactccctgttggacttgatagag

SEQ ID NO: 878 - DNA, 60 bp, Artificial Sequence
  Synthetic oligonucleotide probe
actgttttagaaacggacatagcctcctttgataagagccaagatgattcacttgcgctt

SEQ ID NO: 879 - DNA, 60 bp, Artificial Sequence
  Synthetic oligonucleotide probe
atacactatttgacatgtctgccgaggatttcgatgccatcatagccgcacactttaagc

SEQ ID NO: 880 - DNA, 60 bp, Artificial Sequence
  Synthetic oligonucleotide probe
tgtgaaggtgactcctggtacaaagcacacagaggaaagacctaaggtacaggttataca

SEQ ID NO: 881 - DNA, 60 bp, Artificial Sequence
  Synthetic oligonucleotide probe
tatccgggaagctgagatagaagttgaagggaattctcagctgcaaatctctttctcgac

SEQ ID NO: 882 - DNA, 60 bp, Artificial Sequence
  Synthetic oligonucleotide probe
attattaaatatgcagtcagcaagaaaggcaagtgtgcggtgcattcgatgaccaacgcc

SEQ ID NO: 883 - DNA, 60 bp, Artificial Sequence
  Synthetic oligonucleotide probe
acggtacacgtgccatactctcaggcaccatctggctttaagtattggttaaaagaacga

SEQ ID NO: 884 - DNA, 60 bp, Artificial Sequence
  Synthetic oligonucleotide probe
ttgacaacaaaatcgtggtgtacaaaggtgacgtttacaacatggactacccgccctttg

SEQ ID NO: 885 - DNA, 60 bp, Artificial Sequence
  Synthetic oligonucleotide probe
tcagctaagctccgcgtcctttaccaaggaaataacatcactgtaactgcctatgcaaac

SEQ ID NO: 886 - DNA, 60 bp, Artificial Sequence
  Synthetic oligonucleotide probe
tggagaagtccgaatcatgcaaaacagaatttgcatcagcatacagggctcataccgcat

SEQ ID NO: 887 - DNA, 60 bp, Artificial Sequence
  Synthetic oligonucleotide probe
tatcgcttgattacatcacgtgcgaatacaaaaccgtcatcccgtctccgtacgtgaaat

SEQ ID NO: 888 - DNA, 60 bp, Artificial Sequence
  Synthetic oligonucleotide probe
ttaccatgctgttgtaaaacgttggcttttttagccgtaatgagcatcggtgcccacact

SEQ ID NO: 889 - DNA, 60 bp, Artificial Sequence
  Synthetic oligonucleotide probe
ttatgagctgtaccctactatgactgtagtagttgtgtcagtggcctcgttcatactcct

SEQ ID NO: 890 - DNA, 60 bp, Artificial Sequence
  Synthetic oligonucleotide probe
gaaaaattcacatcccgtttccgctggcaaatgtaacatgcatggtgcctaaagcaagga

SEQ ID NO: 891 - DNA, 60 bp, Artificial Sequence; identical to SEQ ID NO: 888
  Synthetic oligonucleotide probe

SEQ ID NO: 892 - DNA, 60 bp, Artificial Sequence; identical to SEQ ID NO: 889
  Synthetic oligonucleotide probe

SEQ ID NO: 893 - DNA, 60 bp, Artificial Sequence; identical to SEQ ID NO: 890
  Synthetic oligonucleotide probe

SEQ ID NO: 894 - DNA, 60 bp, Artificial Sequence
  Synthetic oligonucleotide probe
actgcaaggttgatcaatgtcatgccgcggtcaccaatcacaaaaagtggcagtataact

SEQ ID NO: 895 - DNA, 60 bp, Artificial Sequence
  Synthetic oligonucleotide probe
ggtataagtgtaattgcggtggctcaaatgaaggactaataactacagataaagtgatta

SEQ ID NO: 896 - DNA, 60 bp, Artificial Sequence
  Synthetic oligonucleotide probe
aaaggagaaactctgacggtgggattcactgacagtaggaagattagtcactcatgtacg

SEQ ID NO: 897 - DNA, 60 bp, Artificial Sequence
  Synthetic oligonucleotide probe
atttgtaagaacatcagcaccatgcacgattactggaacaatgggacacttcatcctggc

SEQ ID NO: 898 - DNA, 60 bp, Artificial Sequence
  Synthetic oligonucleotide probe
aattggaatagggacggatgatagccatgattggaccaagctgcgttacatggacaatca

SEQ ID NO: 899 - DNA, 60 bp, Artificial Sequence
  Synthetic oligonucleotide probe
aacttcaatgtctataaagccacaagaccatacctagctcactgtcccgactgtggagaa

SEQ ID NO: 900 - DNA, 60 bp, Artificial Sequence
  Synthetic oligonucleotide probe
aggacaacgtcatgagacctgggtactatcagctgctacaagcatcattaacatgttctc

SEQ ID NO: 901 - DNA, 60 bp, Artificial Sequence
  Synthetic oligonucleotide probe
caaacatgttgaacataatgaacaggaggaaaagatctgtgaccatgctcctcatgctgc

SEQ ID NO: 902 - DNA, 60 bp, Artificial Sequence
  Synthetic oligonucleotide probe
aagtgttacggggtttcaagaaagaaatctcaaacatgttgaacataatgaacaggagga

SEQ ID NO: 903 - DNA, 60 bp, Artificial Sequence
  Synthetic oligonucleotide probe
caagaagaatggagcgatcaaagtgttacggggtttcaagaaagaaatctcaaacatgtt

SEQ ID NO: 904 - DNA, 60 bp, Artificial Sequence
  Synthetic oligonucleotide probe
attttggctagatggggctcattcaagaagaatggagcgatcaaagtgttacggggtttc

SEQ ID NO: 905 - DNA, 60 bp, Artificial Sequence
  Synthetic oligonucleotide probe
atttctagccatacctccaacagcaggaattttggctagatggggctcattcaagaagaa

SEQ ID NO: 906 - DNA, 60 bp, Artificial Sequence
  Synthetic oligonucleotide probe
gcttttatagcattcctaagatttctagccatacctccaacagcaggaattttggctaga

SEQ ID NO: 907 - DNA, 60 bp, Artificial Sequence
  Synthetic oligonucleotide probe
gacccatgaaattggtgatggcttttatagcattcctaagatttctagccatacctccaa

SEQ ID NO: 908 - DNA, 60 bp, Artificial Sequence
  Synthetic oligonucleotide probe
aggattgctttcaggccaaggacccatgaaattggtgatggcttttatagcattcctaag

SEQ ID NO: 909 - DNA, 60 bp, Artificial Sequence
  Synthetic oligonucleotide probe
acagttggcgaagagattctcaaaaggattgctttcaggccaaggacccatgaaattggt

SEQ ID NO: 910 - DNA, 60 bp, Artificial Sequence
  Synthetic oligonucleotide probe
gagaaaccgcgtgtcaactgtttcacagttggcgaagagattctcaaaaggattgctttc

SEQ ID NO: 911 - DNA, 60 bp, Artificial Sequence
  Synthetic oligonucleotide probe
tccatcacccagaaagggatcatttttattttgctgatgctggtaactccatccatggcc

SEQ ID NO: 912 - DNA, 60 bp, Artificial Sequence
  Synthetic oligonucleotide probe
atccatcacccagaaagggatcatttttattttgctgatgctggtaactccatccatggc

SEQ ID NO: 913 - DNA, 60 bp, Artificial Sequence
  Synthetic oligonucleotide probe
catccatcacccagaaagggatcatttttattttgctgatgctggtaactccatccatgg

SEQ ID NO: 914 - DNA, 60 bp, Artificial Sequence
  Synthetic oligonucleotide probe
acatccatcacccagaaagggatcatttttattttgctgatgctggtaactccatccatg

SEQ ID NO: 915 - DNA, 60 bp, Artificial Sequence
  Synthetic oligonucleotide probe
aacatccatcacccagaaagggatcatttttattttgctgatgctggtaactccatccat

SEQ ID NO: 916 - DNA, 60 bp, Artificial Sequence
  Synthetic oligonucleotide probe
gaacatccatcacccagaaagggatcatttttattttgctgatgctggtaactccatcca

SEQ ID NO: 917 - DNA, 60 bp, Artificial Sequence
  Synthetic oligonucleotide probe
ggaacatccatcacccagaaagggatcatttttattttgctgatgctggtaactccatcc

SEQ ID NO: 918 - DNA, 60 bp, Artificial Sequence
  Synthetic oligonucleotide probe
aggaacatccatcacccagaaagggatcatttttattttgctgatgctggtaactccatc

SEQ ID NO: 919 - DNA, 60 bp, Artificial Sequence
  Synthetic oligonucleotide probe
taggaacatccatcacccagaaagggatcatttttattttgctgatgctggtaactccat

SEQ ID NO: 920 - DNA, 60 bp, Artificial Sequence
  Synthetic oligonucleotide probe
ataggaacatccatcacccagaaagggatcatttttattttgctgatgctggtaactcca

SEQ ID NO: 921 - DNA, 60 bp, Artificial Sequence
  Synthetic oligonucleotide probe
attctgctgacatggctaggattaaactcaaggagcacgtccctttcaatgacgtgtatc

SEQ ID NO: 922 - DNA, 60 bp, Artificial Sequence
  Synthetic oligonucleotide probe
ttgggactgcgtatggagttttgttcagcggtgtttcttggaccatgaagataggaatag

SEQ ID NO: 923 - DNA, 60 bp, Artificial Sequence
  Synthetic oligonucleotide probe
aactaagctggttcaagaagggaagcagtatagggaaaatgtttgaagcaactgcccgtg

SEQ ID NO: 924 - DNA, 60 bp, Artificial Sequence
  Synthetic oligonucleotide probe
aagaaaaaccagtcaacattgaagcggagccaccttttggtgagagctacattgtggtag

SEQ ID NO: 925 - DNA, 60 bp, Artificial Sequence
  Synthetic oligonucleotide probe
aactgttctagtgcaggttaaatacgaaggaacagatgcaccatgcaagatccccttctc

SEQ ID NO: 926 - DNA, 60 bp, Artificial Sequence
  Synthetic oligonucleotide probe
tcatatgtaatgtgcacagggtcattcaagttagagaaggaagtggctgagacccagcat

SEQ ID NO: 927 - DNA, 60 bp, Artificial Sequence
  Synthetic oligonucleotide probe
ggaacgacaacaatttttgcaggacacctgaaatgcagattaaaaatggataaactgatt

SEQ ID NO: 928 - DNA, 60 bp, Artificial Sequence
  Synthetic oligonucleotide probe
caaaaaagcaggaagtagtcgtactaggatcacaagaaggagcaatgcacactgcgttga

SEQ ID NO: 929 - DNA, 60 bp, Artificial Sequence
  Synthetic oligonucleotide probe
caacatcccaagagacttggaatagacaagacttgctggtcacatttaagacagctcatg

SEQ ID NO: 930 - DNA, 60 bp, Artificial Sequence
  Synthetic oligonucleotide probe
gattgttcacctagaacagggctagactttaatgagatggtgttgttgacaatgaaaaaa

SEQ ID NO: 931 - DNA, 60 bp, Artificial Sequence
  Synthetic oligonucleotide probe
atggaaatcagaccagtcaaggagaaggaagagaacctagttaagtcaatggtctctgca

SEQ ID NO: 932 - DNA, 60 bp, Artificial Sequence
  Synthetic oligonucleotide probe
aaccacaacagtcacaggaaagacaatccatgaatggtgctgtagatcttgcacgttacc

SEQ ID NO: 933 - DNA, 60 bp, Artificial Sequence
  Synthetic oligonucleotide probe
atgtgaaggtaccactgttgttgtggatgaacattgtggaaatcgaggaccatctcttag

SEQ ID NO: 934 - DNA, 60 bp, Artificial Sequence
  Synthetic oligonucleotide probe
atatttcacacaaacagcagggccgtggcacttgggcaagttagaactagattttgattt

SEQ ID NO: 935 - DNA, 60 bp, Artificial Sequence
  Synthetic oligonucleotide probe
tgagatgataatcccaaagatatatggaggaccaatatctcagcacaactacagaccagg

SEQ ID NO: 936 - DNA, 60 bp, Artificial Sequence
  Synthetic oligonucleotide probe
aagttaagacatgcatctggccaaaatcccacactctatggagcaatggagtcctggaaa

SEQ ID NO: 937 - DNA, 60 bp, Artificial Sequence
  Synthetic oligonucleotide probe
ggtactggatagaaagtgaaaagaacgagacttggaagttggcaagagcctccttcatag

SEQ ID NO: 938 - DNA, 60 bp, Artificial Sequence
  Synthetic oligonucleotide probe
aacatatggttgaaattgcgtgactcctacactcaagtgtgtgaccaccggctaatgtca

SEQ ID NO: 939 - DNA, 60 bp, Artificial Sequence
  Synthetic oligonucleotide probe
aaccaaagagcatggaacatttgggaagttgaagactatggatttggaattttcacgaca

SEQ ID NO: 940 - DNA, 60 bp, Artificial Sequence
  Synthetic oligonucleotide probe
aagccaaaatcataggagcagatgtacagaataccaccttcatcatcgacggcccaaaca

SEQ ID NO: 941 - DNA, 60 bp, Artificial Sequence
  Synthetic oligonucleotide probe
tctcttggatgcaaaccactaaccatgtttcttataacagaaaacaaaatctggggaagg

SEQ ID NO: 942 - DNA, 60 bp, Artificial Sequence
  Synthetic oligonucleotide probe
tcaattgtatctctcttccctttatgcctgtccacgacttctcaaaaaacaacatggctt

SEQ ID NO: 943 - DNA, 60 bp, Artificial Sequence
  Synthetic oligonucleotide probe
ttcattgcactatgcatggaagacaatggctatgatactgtcaattgtatctctcttccc

SEQ ID NO: 944 - DNA, 60 bp, Artificial Sequence
  Synthetic oligonucleotide probe
gggctaccttgctgtctttaacatttgtcaaaacaactttttcattgcactatgcatgga

SEQ ID NO: 945 - DNA, 60 bp, Artificial Sequence
  Synthetic oligonucleotide probe
atgttgaaattactgactgattttcagtcacatcagctatgggctaccttgctgtcttta

SEQ ID NO: 946 - DNA, 60 bp, Artificial Sequence
  Synthetic oligonucleotide probe
cttagaggagctaggggatggacttgcaatgggcatcatgatgttgaaattactgactga

SEQ ID NO: 947 - DNA, 60 bp, Artificial Sequence
  Synthetic oligonucleotide probe
tcttacagttggattgagtctggtggcatctgtagaactaccaaattccttagaggagct

SEQ ID NO: 948 - DNA, 60 bp, Artificial Sequence
  Synthetic oligonucleotide probe
ggctactgtttcgcagattaacatctagagaagttcttcttcttacagttggattgagtc

SEQ ID NO: 949 - DNA, 60 bp, Artificial Sequence
  Synthetic oligonucleotide probe
caatgggacaattgacatggaatgatctgatcaggctatgtatcatggttggagccaacg

SEQ ID NO: 950 - DNA, 60 bp, Artificial Sequence
  Synthetic oligonucleotide probe
gaaaaatgctgatgactggaacattggctgtgttcctccttctcacaatgggacaattga

SEQ ID NO: 951 - DNA, 60 bp, Artificial Sequence
  Synthetic oligonucleotide probe
ccaatgtcaataccggcgaccctctttgtgtggtatttttggcagaaaaagaaacagaga

SEQ ID NO: 952 - DNA, 60 bp, Artificial Sequence
  Synthetic oligonucleotide probe
cccaatgtcaataccggcgaccctctttgtgtggtatttttggcagaaaaagaaacagag

SEQ ID NO: 953 - DNA, 60 bp, Artificial Sequence
  Synthetic oligonucleotide probe
acccaatgtcaataccggcgaccctctttgtgtggtatttttggcagaaaaagaaacaga

SEQ ID NO: 954 - DNA, 60 bp, Artificial Sequence
  Synthetic oligonucleotide probe
tacccaatgtcaataccggcgaccctctttgtgtggtatttttggcagaaaaagaaacag

SEQ ID NO: 955 - DNA, 60 bp, Artificial Sequence
  Synthetic oligonucleotide probe
atacccaatgtcaataccggcgaccctctttgtgtggtatttttggcagaaaaagaaaca

SEQ ID NO: 956 - DNA, 60 bp, Artificial Sequence
  Synthetic oligonucleotide probe
tatacccaatgtcaataccggcgaccctctttgtgtggtatttttggcagaaaaagaaac

SEQ ID NO: 957 - DNA, 60 bp, Artificial Sequence
  Synthetic oligonucleotide probe
gtatacccaatgtcaataccggcgaccctctttgtgtggtatttttggcagaaaaagaaa

SEQ ID NO: 958 - DNA, 60 bp, Artificial Sequence
  Synthetic oligonucleotide probe
ggtatacccaatgtcaataccggcgaccctctttgtgtggtatttttggcagaaaaagaa

SEQ ID NO: 959 - DNA, 60 bp, Artificial Sequence
  Synthetic oligonucleotide probe
gggtatacccaatgtcaataccggcgaccctctttgtgtggtatttttggcagaaaaaga

SEQ ID NO: 960 - DNA, 60 bp, Artificial Sequence
  Synthetic oligonucleotide probe
aggggtatacccaatgtcaataccggcgaccctctttgtgtggtatttttggcagaaaaa

SEQ ID NO: 961 - DNA, 60 bp, Artificial Sequence
  Synthetic oligonucleotide probe
caaaaatgctccttgacaacataaacacaccagaagggattatcccagccctctttgagc

SEQ ID NO: 962 - DNA, 60 bp, Artificial Sequence
  Synthetic oligonucleotide probe
agtatatttacatgggacagcctctaaacaatgatgaggaccacgcccattggacagaag

SEQ ID NO: 963 - DNA, 60 bp, Artificial Sequence
  Synthetic oligonucleotide probe
tatgttgtcacaacagacatatccgaaatgggagcaaacttccgagccgacagggtaata

SEQ ID NO: 964 - DNA, 60 bp, Artificial Sequence
  Synthetic oligonucleotide probe
caattgagcagaaaaacttttgacactgagtaccagaaaacaaaaaataacgactgggac

SEQ ID NO: 965 - DNA, 60 bp, Artificial Sequence
  Synthetic oligonucleotide probe
agcatcaaatcaggaaatgacattgccaactgtttaagaaagaatgggaaacgggtggtc

SEQ ID NO: 966 - DNA, 60 bp, Artificial Sequence
  Synthetic oligonucleotide probe
tggaactcaggctatgactggatcactgatttcccaggtaaaacagtctggtttgttcca

SEQ ID NO: 967 - DNA, 60 bp, Artificial Sequence
  Synthetic oligonucleotide probe
gcctttccacagagcaatgcagttatccaagatgaggaaagagacattcctgaaagatca

SEQ ID NO: 968 - DNA, 60 bp, Artificial Sequence
  Synthetic oligonucleotide probe
ttatcatggatgaagcacattttaccgatccagccagcatagcagccagagggtatatct

SEQ ID NO: 969 - DNA, 60 bp, Artificial Sequence
  Synthetic oligonucleotide probe
gtcacgccactttcactatgcgtctcctgtctcctgtgagagttcccaattataatatga

SEQ ID NO: 970 - DNA, 60 bp, Artificial Sequence
  Synthetic oligonucleotide probe
ggtatcagacaacagcagtgaagagtgaacacacgggaaaggagatagttgaccttatgt

SEQ ID NO: 971 - DNA, 60 bp, Artificial Sequence
  Synthetic oligonucleotide probe
aaccccattggatagcggcctctatcatactggagttctttctgatggtgttgcttattc

SEQ ID NO: 972 - DNA, 60 bp, Artificial Sequence
  Synthetic oligonucleotide probe
tctaggaaaaacatccattggcctactctgcgtgattgcctcaagtgcactgttatggat

SEQ ID NO: 973 - DNA, 60 bp, Artificial Sequence
  Synthetic oligonucleotide probe
ttgttcttcctatcaggaaggggtctaggaaaaacatccattggcctactctgcgtgatt

SEQ ID NO: 974 - DNA, 60 bp, Artificial Sequence
  Synthetic oligonucleotide probe
atagaaacgttaatgctcctagctttgatagctgtgctgactggtggagtgacgttgttc

SEQ ID NO: 975 - DNA, 60 bp, Artificial Sequence
  Synthetic oligonucleotide probe
tggaagaactaccagacaccatagaaacgttaatgctcctagctttgatagctgtgctga

SEQ ID NO: 976 - DNA, 60 bp, Artificial Sequence
  Synthetic oligonucleotide probe
gaaaagcctatagacacgccatggaagaactaccagacaccatagaaacgttaatgctcc

SEQ ID NO: 977 - DNA, 60 bp, Artificial Sequence
  Synthetic oligonucleotide probe
ttatgttgcacaactctgaacaaggaggaaaagcctatagacacgccatggaagaactac

SEQ ID NO: 978 - DNA, 60 bp, Artificial Sequence
  Synthetic oligonucleotide probe
gaacgccttggacaatctggttatgttgcacaactctgaacaaggaggaaaagcctatag

SEQ ID NO: 979 - DNA, 60 bp, Artificial Sequence
  Synthetic oligonucleotide probe
tagaaatagggaaacttccacaacatttaacgcaaagggcccagaacgccttggacaatc

SEQ ID NO: 980 - DNA, 60 bp, Artificial Sequence
  Synthetic oligonucleotide probe
cgtctcaggtgacctaatattagaaatagggaaacttccacaacatttaacgcaaagggc

SEQ ID NO: 981 - DNA, 60 bp, Artificial Sequence
  Synthetic oligonucleotide probe
agttatctagcaggagcaggtctggccttttcattaatgaaatctctaggaggaggtagg

SEQ ID NO: 982 - DNA, 60 bp, Artificial Sequence
  Synthetic oligonucleotide probe
aaattctggaacaccacgatagcggtgtccatggcaaacatttttaggggaagttatcta

SEQ ID NO: 983 - DNA, 60 bp, Artificial Sequence
  Synthetic oligonucleotide probe
taggccaaataatgttgttgatactttgcacatcacagatcctcctgatgcggaccacat

SEQ ID NO: 984 - DNA, 60 bp, Artificial Sequence
  Synthetic oligonucleotide probe
ttggaccctgtggtttacgatgcaaaatttgaaaaacagctaggccaaataatgttgttg

SEQ ID NO: 985 - DNA, 60 bp, Artificial Sequence
  Synthetic oligonucleotide probe
ataatgaaaaacccaactgtcgacgggatcgttgcaatagatttggaccctgtggtttac

SEQ ID NO: 986 - DNA, 60 bp, Artificial Sequence
  Synthetic oligonucleotide probe
caaaagctactagagaagctcaaaaaaggacagcagccggaataatgaaaaacccaactg

SEQ ID NO: 987 - DNA, 60 bp, Artificial Sequence
  Synthetic oligonucleotide probe
attgatgctagtggctcattatgccataattggacccggactgcaagcaaaagctactag

SEQ ID NO: 988 - DNA, 60 bp, Artificial Sequence
  Synthetic oligonucleotide probe
tattgatgggacttgacaagggatggccaatatcaaagatggacataggagttccacttc

SEQ ID NO: 989 - DNA, 60 bp, Artificial Sequence
  Synthetic oligonucleotide probe
gcaaatatttccctgacagctattgcaaaccaggcagctatattgatgggacttgacaag

SEQ ID NO: 990 - DNA, 60 bp, Artificial Sequence
  Synthetic oligonucleotide probe
tatcactcccatgatgagacacacaattgaaaacacaacggcaaatatttccctgacagc

SEQ ID NO: 991 - DNA, 60 bp, Artificial Sequence
  Synthetic oligonucleotide probe
agacttcatgacatcaatgaagagattcaaaaacgagagtgatcccgaaggggcactctg

SEQ ID NO: 992 - DNA, 60 bp, Artificial Sequence
  Synthetic oligonucleotide probe
caccaacatacaagtggccataaaccaagtgagaaggctcattgggaatgagaattatct

SEQ ID NO: 993 - DNA, 60 bp, Artificial Sequence
  Synthetic oligonucleotide probe
atacctaggaaaaagggaagatcaatggtgtggttccctaataggcttaacagcacgagc

SEQ ID NO: 994 - DNA, 60 bp, Artificial Sequence
  Synthetic oligonucleotide probe
ttgtcagtgtggaatagggtttggatagaggaaaacccatggatggaggacaagactcat

SEQ ID NO: 995 - DNA, 60 bp, Artificial Sequence
  Synthetic oligonucleotide probe
aaatgtggcagctgatgtacttccacaggagagacttgagattagcggctaatgctatct

SEQ ID NO: 996 - DNA, 60 bp, Artificial Sequence
  Synthetic oligonucleotide probe
attggcaacaagtgcctttctgttcacaccatttccaccagctgattatgaaggatggga

SEQ ID NO: 997 - DNA, 60 bp, Artificial Sequence
  Synthetic oligonucleotide probe
atgacatgggaaaggtaagaaaagacataccgcaatgggaaccttcaaaaggatggaatg

SEQ ID NO: 998 - DNA, 60 bp, Artificial Sequence
  Synthetic oligonucleotide probe
gagatgactgtgtggtgaaaccaatcgatgacagatttgcaacagccttaacagctttga

SEQ ID NO: 999 - DNA, 60 bp, Artificial Sequence
  Synthetic oligonucleotide probe
aaagagtcctcgactggttgaaaaaacatggcaccgagaggctgaaaagaatggcaatca

SEQ ID NO: 1000 - DNA, 60 bp, Artificial Sequence
  Synthetic oligonucleotide probe
aagacaaatggagtctgagggaatcttttcacccagcgaattggaaaccccaaatctagc

SEQ ID NO: 1001 - DNA, 60 bp, Artificial Sequence
  Synthetic oligonucleotide probe
tcttgaataggagacgcagatctgcaggcatgatcattatgctgattccaacagtgatgg

SEQ ID NO: 1002 - DNA, 60 bp, Artificial Sequence
  Synthetic oligonucleotide probe
atcttgaataggagacgcagatctgcaggcatgatcattatgctgattccaacagtgatg

SEQ ID NO: 1003 - DNA, 60 bp, Artificial Sequence
  Synthetic oligonucleotide probe
catcttgaataggagacgcagatctgcaggcatgatcattatgctgattccaacagtgat

SEQ ID NO: 1004 - DNA, 60 bp, Artificial Sequence
  Synthetic oligonucleotide probe
acatcttgaataggagacgcagatctgcaggcatgatcattatgctgattccaacagtga

SEQ ID NO: 1005 - DNA, 60 bp, Artificial Sequence
  Synthetic oligonucleotide probe
aacatcttgaataggagacgcagatctgcaggcatgatcattatgctgattccaacagtg

SEQ ID NO: 1006 - DNA, 60 bp, Artificial Sequence
  Synthetic oligonucleotide probe
gaacatcttgaataggagacgcagatctgcaggcatgatcattatgctgattccaacagt

SEQ ID NO: 1007 - DNA, 60 bp, Artificial Sequence
  Synthetic oligonucleotide probe
tgaacatcttgaataggagacgcagatctgcaggcatgatcattatgctgattccaacag

SEQ ID NO: 1008 - DNA, 60 bp, Artificial Sequence
  Synthetic oligonucleotide probe
ctgaacatcttgaataggagacgcagatctgcaggcatgatcattatgctgattccaaca

SEQ ID NO: 1009 - DNA, 60 bp, Artificial Sequence
  Synthetic oligonucleotide probe
gctgaacatcttgaataggagacgcagatctgcaggcatgatcattatgctgattccaac

SEQ ID NO: 1010 - DNA, 60 bp, Artificial Sequence
  Synthetic oligonucleotide probe
tgctgaacatcttgaataggagacgcagatctgcaggcatgatcattatgctgattccaa

SEQ ID NO: 1011 - DNA, 60 bp, Artificial Sequence
  Synthetic oligonucleotide probe
acacatttccaaagagccctgattttcatcttactgacagctgtcactccttcaatgaca

SEQ ID NO: 1012 - DNA, 60 bp, Artificial Sequence
  Synthetic oligonucleotide probe
tggcatacaccataggaacgacacatttccaaagagccctgattttcatcttactgacag

SEQ ID NO: 1013 - DNA, 60 bp, Artificial Sequence
  Synthetic oligonucleotide probe
aattgaaacttggatcttgagacatccaggcttcaccatgatggcagcaatcctggcata

SEQ ID NO: 1014 - DNA, 60 bp, Artificial Sequence
  Synthetic oligonucleotide probe
tcatcagaaggggcctggaaacatgtccagagaattgaaacttggatcttgagacatcca

SEQ ID NO: 1015 - DNA, 60 bp, Artificial Sequence
  Synthetic oligonucleotide probe
cacgaactgaaacatggatgtcatcagaaggggcctggaaacatgtccagagaattgaaa

SEQ ID NO: 1016 - DNA, 60 bp, Artificial Sequence
  Synthetic oligonucleotide probe
aacatagaagagaaaaaagatcagtggcactcgttccacatgtgggaatgggactggaga

SEQ ID NO: 1017 - DNA, 60 bp, Artificial Sequence
  Synthetic oligonucleotide probe
tatgggacgtgtaccaccatgggagaacatagaagagaaaaaagatcagtggcactcgtt

SEQ ID NO: 1018 - DNA, 60 bp, Artificial Sequence
  Synthetic oligonucleotide probe
gaaaagtcttctgtttaaaacagaggatggcgtgaacatgtgtaccctcatggccatgga

SEQ ID NO: 1019 - DNA, 60 bp, Artificial Sequence
  Synthetic oligonucleotide probe
gtcagcagacaagagaaagggaaaagtcttctgtttaaaacagaggatggcgtgaacatg

SEQ ID NO: 1020 - DNA, 60 bp, Artificial Sequence
  Synthetic oligonucleotide probe
acggagaaccacacatgatcgtcagcagacaagagaaagggaaaagtcttctgtttaaaa

SEQ ID NO: 1021 - DNA, 60 bp, Artificial Sequence
  Synthetic oligonucleotide probe
actgtctgtgacactagtattggtgggaattgtgacactgtatttgggagtcatggtgca

SEQ ID NO: 1022 - DNA, 60 bp, Artificial Sequence
  Synthetic oligonucleotide probe
tatgaaaatcctcataggagtcattatcacatggataggaatgaattcacgcagcacctc

SEQ ID NO: 1023 - DNA, 60 bp, Artificial Sequence
  Synthetic oligonucleotide probe
ttacatctataggaaaggctctccaccaagtctttggagcaatctatggagctgccttca

SEQ ID NO: 1024 - DNA, 60 bp, Artificial Sequence
  Synthetic oligonucleotide probe
agttctatcggccaaatgtttgagacaacaatgaggggggcgaagagaatggccatttta

SEQ ID NO: 1025 - DNA, 60 bp, Artificial Sequence
  Synthetic oligonucleotide probe
agctacatcatcataggagtagagccgggacaactgaagctcaactggtttaagaaagga

SEQ ID NO: 1026 - DNA, 60 bp, Artificial Sequence
  Synthetic oligonucleotide probe
ccaattgtgacagaaaaagatagcccagtcaacatagaagcagaacctccattcggagac

SEQ ID NO: 1027 - DNA, 60 bp, Artificial Sequence
  Synthetic oligonucleotide probe
ccttttgagataatggatttggaaaaaagacatgtcttaggtcgcctgattacagtcaac

SEQ ID NO: 1028 - DNA, 60 bp, Artificial Sequence
  Synthetic oligonucleotide probe
caacatggaacaatagttatcagagtgcaatatgaaggggacggctctccatgcaagatc

SEQ ID NO: 1029 - DNA, 60 bp, Artificial Sequence
  Synthetic oligonucleotide probe
ggaatgtcatactctatgtgcacaggaaagtttaaagttgtgaaggaaatagcagaaaca

SEQ ID NO: 1030 - DNA, 60 bp, Artificial Sequence
  Synthetic oligonucleotide probe
aacttactcttcacaggacatctcaagtgcaggctgagaatggacaagctacagctcaaa

SEQ ID NO: 1031 - DNA, 60 bp, Artificial Sequence
  Synthetic oligonucleotide probe
atggaaatcagaccattgaaggagaaagaagagaatttggtcaactccttggtcacagct

SEQ ID NO: 1032 - DNA, 60 bp, Artificial Sequence
  Synthetic oligonucleotide probe
aaactcataacagaatggtgctgccgatcttgcacattaccaccgctaagatacagaggt

SEQ ID NO: 1033 - DNA, 60 bp, Artificial Sequence
  Synthetic oligonucleotide probe
actttgatttctgtgatggaacaacagtggtagtgactgaggactgcggaaatagaggac

SEQ ID NO: 1034 - DNA, 60 bp, Artificial Sequence
  Synthetic oligonucleotide probe
atagaccaggctaccatacacaaataacaggaccatggcatctaggtaagcttgagatgg

SEQ ID NO: 1035 - DNA, 60 bp, Artificial Sequence
  Synthetic oligonucleotide probe
tgctagaaagtgagatgataattccaaagaatctcgctggaccagtgtctcaacacaact

SEQ ID NO: 1036 - DNA, 60 bp, Artificial Sequence
  Synthetic oligonucleotide probe
ctttcattgaagttaaaaactgccactggccaaaatcacacaccctctggagcaatggag

SEQ ID NO: 1037 - DNA, 60 bp, Artificial Sequence
  Synthetic oligonucleotide probe
ccgatatgggttattggatagaaagtgcactcaatgacacatggaagatagagaaagcct

SEQ ID NO: 1038 - DNA, 60 bp, Artificial Sequence
  Synthetic oligonucleotide probe
aaacaggatgtattctgcgactcaaaactcatgtcagcggccataaaagacaacagagcc

SEQ ID NO: 1039 - DNA, 60 bp, Artificial Sequence
  Synthetic oligonucleotide probe
gaagttgaagactatggctttggagtattcaccaccaatatatggctaaaattgaaagaa

SEQ ID NO: 1040 - DNA, 60 bp, Artificial Sequence
  Synthetic oligonucleotide probe
caaaaatgctctctacagagtctcataaccagacctttctcattgatggccccgaaacag

SEQ ID NO: 1041 - DNA, 60 bp, Artificial Sequence
  Synthetic oligonucleotide probe
tcctcacagcaaaaaacagattggataccattagcattgacgatcaaaggtctcaatcca

SEQ ID NO: 1042 - DNA, 60 bp, Artificial Sequence
  Synthetic oligonucleotide probe
acaatattggcagtggtgtccgtttccccactgctcttaacatcctcacagcaaaaaaca

SEQ ID NO: 1043 - DNA, 60 bp, Artificial Sequence
  Synthetic oligonucleotide probe
aaacgcagtgatattacaaaacgcatggaaagtgagttgcacaatattggcagtggtgtc

SEQ ID NO: 1044 - DNA, 60 bp, Artificial Sequence
  Synthetic oligonucleotide probe
atcaattggcagtgactatcatggctatcttgtgcgtcccaaacgcagtgatattacaaa

SEQ ID NO: 1045 - DNA, 60 bp, Artificial Sequence
  Synthetic oligonucleotide probe
ggcatgatggtcctcaaaatggtgagaaatatggaaaagtatcaattggcagtgactatc

SEQ ID NO: 1046 - DNA, 60 bp, Artificial Sequence
  Synthetic oligonucleotide probe
ataccagagaccattcttgagttgactgatgcgttagccttaggcatgatggtcctcaaa

SEQ ID NO: 1047 - DNA, 60 bp, Artificial Sequence
  Synthetic oligonucleotide probe
gatgactactataggaattgtactcctctcccagagcaccataccagagaccattcttga

SEQ ID NO: 1048 - DNA, 60 bp, Artificial Sequence
  Synthetic oligonucleotide probe
ctggactactcttgagaaagctgacctccaaggaattgatgatgactactataggaattg

SEQ ID NO: 1049 - DNA, 60 bp, Artificial Sequence
  Synthetic oligonucleotide probe
ttatcttgccctactagcagccttcaaagtcagaccaacttttgcagctggactactctt

SEQ ID NO: 1050 - DNA, 60 bp, Artificial Sequence
  Synthetic oligonucleotide probe
ttgtgacattgatcacagggaacatgtcctttagagacctgggaagagtgatggttatgg

SEQ ID NO: 1051 - DNA, 60 bp, Artificial Sequence
  Synthetic oligonucleotide probe
tttcctgtatcaataccaatcacggcagcagcatggtacctgtgggaagtgaagaaacaa

SEQ ID NO: 1052 - DNA, 60 bp, Artificial Sequence
  Synthetic oligonucleotide probe
ttttcctgtatcaataccaatcacggcagcagcatggtacctgtgggaagtgaagaaaca

SEQ ID NO: 1053 - DNA, 60 bp, Artificial Sequence
  Synthetic oligonucleotide probe
tttttcctgtatcaataccaatcacggcagcagcatggtacctgtgggaagtgaagaaac

SEQ ID NO: 1054 - DNA, 60 bp, Artificial Sequence
  Synthetic oligonucleotide probe
ctttttcctgtatcaataccaatcacggcagcagcatggtacctgtgggaagtgaagaaa

SEQ ID NO: 1055 - DNA, 60 bp, Artificial Sequence
  Synthetic oligonucleotide probe
actttttcctgtatcaataccaatcacggcagcagcatggtacctgtgggaagtgaagaa

SEQ ID NO: 1056 - DNA, 60 bp, Artificial Sequence
  Synthetic oligonucleotide probe
attgctggtgatctcaggactttttcctgtatcaataccaatcacggcagcagcatggta

SEQ ID NO: 1057 - DNA, 60 bp, Artificial Sequence
  Synthetic oligonucleotide probe
agaacaggattgctggtgatctcaggactttttcctgtatcaataccaatcacggcagca

SEQ ID NO: 1058 - DNA, 60 bp, Artificial Sequence
  Synthetic oligonucleotide probe
tagaacaggattgctggtgatctcaggactttttcctgtatcaataccaatcacggcagc

SEQ ID NO: 1059 - DNA, 60 bp, Artificial Sequence
  Synthetic oligonucleotide probe
ttagaacaggattgctggtgatctcaggactttttcctgtatcaataccaatcacggcag

SEQ ID NO: 1060 - DNA, 60 bp, Artificial Sequence
  Synthetic oligonucleotide probe
attagaacaggattgctggtgatctcaggactttttcctgtatcaataccaatcacggca

SEQ ID NO: 1061 - DNA, 60 bp, Artificial Sequence
  Synthetic oligonucleotide probe
aggatctattctgacccactggcgctaaaagaatttaaggaatttgcagccggaagaaag

SEQ ID NO: 1062 - DNA, 60 bp, Artificial Sequence
  Synthetic oligonucleotide probe
gttgaaatctggacaaaagaaggggaaaggaagaaattgaaacccagatggttggatgct

SEQ ID NO: 1063 - DNA, 60 bp, Artificial Sequence
  Synthetic oligonucleotide probe
gacagaaggtggtgttttgatggagtcaagaacaaccaaatcctagaagaaaacgtggaa

SEQ ID NO: 1064 - DNA, 60 bp, Artificial Sequence
  Synthetic oligonucleotide probe
gaaaacctttgtagacttaatgagaagaggagacctaccagtctggttggcctacagagt

SEQ ID NO: 1065 - DNA, 60 bp, Artificial Sequence
  Synthetic oligonucleotide probe
aatcattcctagcatgttcgaaccagagcgtgaaaaggtggatgccattgatggcgaata

SEQ ID NO: 1066 - DNA, 60 bp, Artificial Sequence
  Synthetic oligonucleotide probe
agactgtgcacactggaaagaagctaaaatgctcctagataacatcaacacgccagaagg

SEQ ID NO: 1067 - DNA, 60 bp, Artificial Sequence
  Synthetic oligonucleotide probe
aaatccaaaaaatgagaatgaccagtacatatacatgggggaacctctggaaaatgatga

SEQ ID NO: 1068 - DNA, 60 bp, Artificial Sequence
  Synthetic oligonucleotide probe
aatttcaaggctgagagggttatagaccccagacgctgcatgaaaccagtcatactaaca

SEQ ID NO: 1069 - DNA, 60 bp, Artificial Sequence
  Synthetic oligonucleotide probe
aagactagaaccaatgattgggacttcgtggttacaactgacatttcagaaatgggtgcc

SEQ ID NO: 1070 - DNA, 60 bp, Artificial Sequence
  Synthetic oligonucleotide probe
aggaaaaatggaaagaaagtgatacaactcagtaggaagacctttgattctgagtatgtc

SEQ ID NO: 1071 - DNA, 60 bp, Artificial Sequence
  Synthetic oligonucleotide probe
gatagcagcttcaataatactggagttttttctcatagttttgcttattccagaacctga

SEQ ID NO: 1072 - DNA, 60 bp, Artificial Sequence
  Synthetic oligonucleotide probe
ggatagcagcttcaataatactggagttttttctcatagttttgcttattccagaacctg

SEQ ID NO: 1073 - DNA, 60 bp, Artificial Sequence
  Synthetic oligonucleotide probe
tggatagcagcttcaataatactggagttttttctcatagttttgcttattccagaacct

SEQ ID NO: 1074 - DNA, 60 bp, Artificial Sequence
  Synthetic oligonucleotide probe
ctggatagcagcttcaataatactggagttttttctcatagttttgcttattccagaacc

SEQ ID NO: 1075 - DNA, 60 bp, Artificial Sequence
  Synthetic oligonucleotide probe
actggatagcagcttcaataatactggagttttttctcatagttttgcttattccagaac

SEQ ID NO: 1076 - DNA, 60 bp, Artificial Sequence
  Synthetic oligonucleotide probe
cactggatagcagcttcaataatactggagttttttctcatagttttgcttattccagaa

SEQ ID NO: 1077 - DNA, 60 bp, Artificial Sequence
  Synthetic oligonucleotide probe
acactggatagcagcttcaataatactggagttttttctcatagttttgcttattccaga

SEQ ID NO: 1078 - DNA, 60 bp, Artificial Sequence
  Synthetic oligonucleotide probe
cacactggatagcagcttcaataatactggagttttttctcatagttttgcttattccag

SEQ ID NO: 1079 - DNA, 60 bp, Artificial Sequence
  Synthetic oligonucleotide probe
ccacactggatagcagcttcaataatactggagttttttctcatagttttgcttattcca

SEQ ID NO: 1080 - DNA, 60 bp, Artificial Sequence
  Synthetic oligonucleotide probe
gccacactggatagcagcttcaataatactggagttttttctcatagttttgcttattcc

SEQ ID NO: 1081 - DNA, 60 bp, Artificial Sequence
  Synthetic oligonucleotide probe
agttacttggccggagctggacttctcttttctattatgaagaacacaaccaacacaaga

SEQ ID NO: 1082 - DNA, 60 bp, Artificial Sequence
  Synthetic oligonucleotide probe
ggttttggaacactaccattgcggtgtcaatggctaacatttttagagggagttacttgg

SEQ ID NO: 1083 - DNA, 60 bp, Artificial Sequence
  Synthetic oligonucleotide probe
gtgactcaagtattgatgatgaggactacatgggctctgtgtgaggctttaaccttagct

SEQ ID NO: 1084 - DNA, 60 bp, Artificial Sequence
  Synthetic oligonucleotide probe
ttgaaaagcagttgggacaagtaatgctcctagtcctctgcgtgactcaagtattgatga

SEQ ID NO: 1085 - DNA, 60 bp, Artificial Sequence
  Synthetic oligonucleotide probe
acagtgattgacctagatccaataccttatgatccaaagtttgaaaagcagttgggacaa

SEQ ID NO: 1086 - DNA, 60 bp, Artificial Sequence
  Synthetic oligonucleotide probe
ttttcttattggtagcacattatgccatcatagggccaggactccaagcaaaagcaacca

SEQ ID NO: 1087 - DNA, 60 bp, Artificial Sequence
  Synthetic oligonucleotide probe
ttggatgctactcacaagtcaaccccataactctcacagcagctcttttcttattggtag

SEQ ID NO: 1088 - DNA, 60 bp, Artificial Sequence
  Synthetic oligonucleotide probe
tgaaaattcctcagtgaatgtgtccctaacagctatagccaaccaagccacagtgttaat

SEQ ID NO: 1089 - DNA, 60 bp, Artificial Sequence
  Synthetic oligonucleotide probe
tggccacaacatttgttacaccaatgttgagacatagcattgaaaattcctcagtgaatg

SEQ ID NO: 1090 - DNA, 60 bp, Artificial Sequence
  Synthetic oligonucleotide probe
gatgggtttcctagaaaaaacgaagaaagatctcggattgggaagcattgcaacccagca

SEQ ID NO: 1091 - DNA, 60 bp, Artificial Sequence
  Synthetic oligonucleotide probe
gattacatgccatccatgaaaagattcagaagagaagaggaagaagcaggagttctgtgg

SEQ ID NO: 1092 - DNA, 60 bp, Artificial Sequence
  Synthetic oligonucleotide probe
aagaacatccaagcagcaataaatcaagttagatcccttataggcaatgaagaatacaca

SEQ ID NO: 1093 - DNA, 60 bp, Artificial Sequence
  Synthetic oligonucleotide probe
aatcccatacttggggaaaagagaagaccaatggtgcggctcattgattgggttaacaag

SEQ ID NO: 1094 - DNA, 60 bp, Artificial Sequence
  Synthetic oligonucleotide probe
aacagggtgtggattcaagaaaacccatggatggaagacaaaactccagtggaatcatgg

SEQ ID NO: 1095 - DNA, 60 bp, Artificial Sequence
  Synthetic oligonucleotide probe
aacctggtccatacatgctaaacatgaatggatgacaacggaagacatgctgacagtctg

SEQ ID NO: 1096 - DNA, 60 bp, Artificial Sequence
  Synthetic oligonucleotide probe
atgaaagacggtcgcgtactcgttgttccatgtagaaaccaagatgaactgattggcaga

SEQ ID NO: 1097 - DNA, 60 bp, Artificial Sequence
  Synthetic oligonucleotide probe
agaggatggaatgattggacacaagtgcccttctgttcacaccatttccatgagttaatc

SEQ ID NO: 1098 - DNA, 60 bp, Artificial Sequence
  Synthetic oligonucleotide probe
ttaacagctctaaatgacatgggaaagattaggaaagacatacaacaatgggaaccttca

SEQ ID NO: 1099 - DNA, 60 bp, Artificial Sequence
  Synthetic oligonucleotide probe
agaatggccatcagtggagatgattgtgttgtgaaacctttagatgacaggttcgcaagc

SEQ ID NO: 1100 - DNA, 60 bp, Artificial Sequence
  Synthetic oligonucleotide probe
attcagcacctaacaatcacagaagaaatcgctgtgcaaaactggttagcaagagtgggg

SEQ ID NO: 1101 - DNA, 60 bp, Artificial Sequence
  Synthetic oligonucleotide probe
atcaaccaacggaaaaagacatcgctctgtctcatgatgatattgccagcagcacttgct

SEQ ID NO: 1102 - DNA, 60 bp, Artificial Sequence
  Synthetic oligonucleotide probe
aatcaaccaacggaaaaagacatcgctctgtctcatgatgatattgccagcagcacttgc

SEQ ID NO: 1103 - DNA, 60 bp, Artificial Sequence
  Synthetic oligonucleotide probe
taatcaaccaacggaaaaagacatcgctctgtctcatgatgatattgccagcagcacttg

SEQ ID NO: 1104 - DNA, 60 bp, Artificial Sequence
  Synthetic oligonucleotide probe
ataatcaaccaacggaaaaagacatcgctctgtctcatgatgatattgccagcagcactt

SEQ ID NO: 1105 - DNA, 60 bp, Artificial Sequence
  Synthetic oligonucleotide probe
cataatcaaccaacggaaaaagacatcgctctgtctcatgatgatattgccagcagcact

SEQ ID NO: 1106 - DNA, 60 bp, Artificial Sequence
  Synthetic oligonucleotide probe
gcataatcaaccaacggaaaaagacatcgctctgtctcatgatgatattgccagcagcac

SEQ ID NO: 1107 - DNA, 60 bp, Artificial Sequence
  Synthetic oligonucleotide probe
agcataatcaaccaacggaaaaagacatcgctctgtctcatgatgatattgccagcagca

SEQ ID NO: 1108 - DNA, 60 bp, Artificial Sequence
  Synthetic oligonucleotide probe
gagcataatcaaccaacggaaaaagacatcgctctgtctcatgatgatattgccagcagc

SEQ ID NO: 1109 - DNA, 60 bp, Artificial Sequence
  Synthetic oligonucleotide probe
tgagcataatcaaccaacggaaaaagacatcgctctgtctcatgatgatattgccagcag

SEQ ID NO: 1110 - DNA, 60 bp, Artificial Sequence
  Synthetic oligonucleotide probe
ctgagcataatcaaccaacggaaaaagacatcgctctgtctcatgatgatattgccagca

SEQ ID NO: 1111 - DNA, 60 bp, Artificial Sequence
  Synthetic oligonucleotide probe
tccctgacccagaaggtggttattttcatattattaatgctggtcaccccatccatgaca

SEQ ID NO: 1112 - DNA, 60 bp, Artificial Sequence
  Synthetic oligonucleotide probe
ttccctgacccagaaggtggttattttcatattattaatgctggtcaccccatccatgac

SEQ ID NO: 1113 - DNA, 60 bp, Artificial Sequence
  Synthetic oligonucleotide probe
cttccctgacccagaaggtggttattttcatattattaatgctggtcaccccatccatga

SEQ ID NO: 1114 - DNA, 60 bp, Artificial Sequence
  Synthetic oligonucleotide probe
acttccctgacccagaaggtggttattttcatattattaatgctggtcaccccatccatg

SEQ ID NO: 1115 - DNA, 60 bp, Artificial Sequence
  Synthetic oligonucleotide probe
cacttccctgacccagaaggtggttattttcatattattaatgctggtcaccccatccat

SEQ ID NO: 1116 - DNA, 60 bp, Artificial Sequence
  Synthetic oligonucleotide probe
gcacttccctgacccagaaggtggttattttcatattattaatgctggtcaccccatcca

SEQ ID NO: 1117 - DNA, 60 bp, Artificial Sequence
  Synthetic oligonucleotide probe
aggcacttccctgacccagaaggtggttattttcatattattaatgctggtcaccccatc

SEQ ID NO: 1118 - DNA, 60 bp, Artificial Sequence
  Synthetic oligonucleotide probe
taggcacttccctgacccagaaggtggttattttcatattattaatgctggtcaccccat

SEQ ID NO: 1119 - DNA, 60 bp, Artificial Sequence
  Synthetic oligonucleotide probe
ataggcacttccctgacccagaaggtggttattttcatattattaatgctggtcacccca

SEQ ID NO: 1120 - DNA, 60 bp, Artificial Sequence
  Synthetic oligonucleotide probe
cataggcacttccctgacccagaaggtggttattttcatattattaatgctggtcacccc

SEQ ID NO: 1121 - DNA, 60 bp, Artificial Sequence
  Synthetic oligonucleotide probe
tcattttcatgcattgcgataggaatcattacactctatctgggagctgtggtacaagct

SEQ ID NO: 1122 - DNA, 60 bp, Artificial Sequence
  Synthetic oligonucleotide probe
gaaaattggaataggtgtcctcttgacttggatagggttgaattcaaaaaacacatccat

SEQ ID NO: 1123 - DNA, 60 bp, Artificial Sequence
  Synthetic oligonucleotide probe
aatggtgcaccaaatatttggaagtgcttatacagccctgttcagtggagtctcttgggt

SEQ ID NO: 1124 - DNA, 60 bp, Artificial Sequence
  Synthetic oligonucleotide probe
aattggagacaacgccttgaaaatcaactggtacaagaaggggagctcgattgggaagat

SEQ ID NO: 1125 - DNA, 60 bp, Artificial Sequence
  Synthetic oligonucleotide probe
ggaggagcctgtcaatattgaggctgaacctccttttggggaaagcaatatagtaattgg

SEQ ID NO: 1126 - DNA, 60 bp, Artificial Sequence
  Synthetic oligonucleotide probe
aagattcccttttccacagaggatggacaagggaaagctcataatggcagactgatcaca

SEQ ID NO: 1127 - DNA, 60 bp, Artificial Sequence
  Synthetic oligonucleotide probe
aagtctcagaaacgcagcacgggacaatactcattaaggttgagtacaaaggggaagatg

SEQ ID NO: 1128 - DNA, 60 bp, Artificial Sequence
  Synthetic oligonucleotide probe
aattggaactcaaggggatgagctatgcaatgtgcacgaatacctttgtgttgaagaaag

SEQ ID NO: 1129 - DNA, 60 bp, Artificial Sequence
  Synthetic oligonucleotide probe
caaaactcaggaggcacaagcattttcgcggggcacttaaaatgtagacttaagatggac

SEQ ID NO: 1130 - DNA, 60 bp, Artificial Sequence
  Synthetic oligonucleotide probe
acgcacatgcgaaaaaacaagaagtagttgtccttggatcgcaagagggagcaatgcata

SEQ ID NO: 1131 - DNA, 60 bp, Artificial Sequence
  Synthetic oligonucleotide probe
atggaaatcagacccatcagtgagaaagaagagaacatggtaaagtctttagtctcagcg

SEQ ID NO: 1132 - DNA, 60 bp, Artificial Sequence
  Synthetic oligonucleotide probe
aagaggcccatcattgagaacaacaacagtgtcagggaagttgatacacgaatggtgttg

SEQ ID NO: 1133 - DNA, 60 bp, Artificial Sequence
  Synthetic oligonucleotide probe
attggagctggacttcaactactgtgaaggaacaacagttgtcatcacagaaagctgtgg

SEQ ID NO: 1134 - DNA, 60 bp, Artificial Sequence
  Synthetic oligonucleotide probe
agagagtgacatgatcatcccaaagagtctagctggtcctatctcacaacacaactacag

SEQ ID NO: 1135 - DNA, 60 bp, Artificial Sequence
  Synthetic oligonucleotide probe
catagaggtaaaaacctgcacatggccaaaatcacacactctctggactaatggtgtgct

SEQ ID NO: 1136 - DNA, 60 bp, Artificial Sequence
  Synthetic oligonucleotide probe
catgggctactggatagaaagccaaaagaatggaagttggaagctagaaaaagcatccct

SEQ ID NO: 1137 - DNA, 60 bp, Artificial Sequence
  Synthetic oligonucleotide probe
aaccaacatatggctgaaactccgagaggtctacacccaactatgtgaccataggctaat

SEQ ID NO: 1138 - DNA, 60 bp, Artificial Sequence
  Synthetic oligonucleotide probe
aaacacaaaattcctctttcataatagacgggccaaacacaccggagtgtccaagtgcct

SEQ ID NO: 1139 - DNA, 60 bp, Artificial Sequence
  Synthetic oligonucleotide probe
aacccatggagctaaaatactcatggaaaacgtggggaaaggcaaaaatagtgacagctg

SEQ ID NO: 1140 - DNA, 60 bp, Artificial Sequence
  Synthetic oligonucleotide probe
ttaacggtagttgtgggcgatacacttggggtcttagagcaagggaaaagaacactaaca

SEQ ID NO: 1141 - DNA, 60 bp, Artificial Sequence
  Synthetic oligonucleotide probe
gctatgggagttccaccccttccactttttatttttagcttgaaagacacactcaaaagg

SEQ ID NO: 1142 - DNA, 60 bp, Artificial Sequence
  Synthetic oligonucleotide probe
attttggccggagtttcgcttttaccagtgtgccagtcttcaagcatgaggaaaacagat

SEQ ID NO: 1143 - DNA, 60 bp, Artificial Sequence
  Synthetic oligonucleotide probe
tcaaacacaatttttacgttgactgttgcctggagaacagccactctgattttggccgga

SEQ ID NO: 1144 - DNA, 60 bp, Artificial Sequence
  Synthetic oligonucleotide probe
aacataccaattgtggacggcattagtctccttaacgtgttcaaacacaatttttacgtt

SEQ ID NO: 1145 - DNA, 60 bp, Artificial Sequence
  Synthetic oligonucleotide probe
ctctggggctcatggctcttaaactgataacacaatttgaaacataccaattgtggacgg

SEQ ID NO: 1146 - DNA, 60 bp, Artificial Sequence
  Synthetic oligonucleotide probe
aatttattgttaggagttgggttggccatggcaacaacgttacaactgccagaggacatt

SEQ ID NO: 1147 - DNA, 60 bp, Artificial Sequence
  Synthetic oligonucleotide probe
tggctttgggatttttcctaagaaagctgacatctagagaaaatttattgttaggagttg

SEQ ID NO: 1148 - DNA, 60 bp, Artificial Sequence
  Synthetic oligonucleotide probe
tacctagctctaattgcaacatttaaaatccagccattcttggctttgggatttttccta

SEQ ID NO: 1149 - DNA, 60 bp, Artificial Sequence
  Synthetic oligonucleotide probe
gtttgtgctccttctctcagggcaaataacatggagagacatggcgcacacactaataat

SEQ ID NO: 1150 - DNA, 60 bp, Artificial Sequence
  Synthetic oligonucleotide probe
aaatttgggaagaaacacatgattgcaggggttttctttacgtttgtgctccttctctca

SEQ ID NO: 1151 - DNA, 60 bp, Artificial Sequence
  Synthetic oligonucleotide probe
atttttccatactccatacccgcaacattgttggtctggcacacttggcaaaaacaaacc

SEQ ID NO: 1152 - DNA, 60 bp, Artificial Sequence
  Synthetic oligonucleotide probe
catttttccatactccatacccgcaacattgttggtctggcacacttggcaaaaacaaac

SEQ ID NO: 1153 - DNA, 60 bp, Artificial Sequence
  Synthetic oligonucleotide probe
gcatttttccatactccatacccgcaacattgttggtctggcacacttggcaaaaacaaa

SEQ ID NO: 1154 - DNA, 60 bp, Artificial Sequence
  Synthetic oligonucleotide probe
ggcatttttccatactccatacccgcaacattgttggtctggcacacttggcaaaaacaa

SEQ ID NO: 1155 - DNA, 60 bp, Artificial Sequence
  Synthetic oligonucleotide probe
aggcatttttccatactccatacccgcaacattgttggtctggcacacttggcaaaaaca

SEQ ID NO: 1156 - DNA, 60 bp, Artificial Sequence
  Synthetic oligonucleotide probe
tcaggcatttttccatactccatacccgcaacattgttggtctggcacacttggcaaaaa

SEQ ID NO: 1157 - DNA, 60 bp, Artificial Sequence
  Synthetic oligonucleotide probe
atcaggcatttttccatactccatacccgcaacattgttggtctggcacacttggcaaaa

SEQ ID NO: 1158 - DNA, 60 bp, Artificial Sequence
  Synthetic oligonucleotide probe
tatcaggcatttttccatactccatacccgcaacattgttggtctggcacacttggcaaa

SEQ ID NO: 1159 - DNA, 60 bp, Artificial Sequence
  Synthetic oligonucleotide probe
atagtatcaggcatttttccatactccatacccgcaacattgttggtctggcacacttgg

SEQ ID NO: 1160 - DNA, 60 bp, Artificial Sequence
  Synthetic oligonucleotide probe
aatagtatcaggcatttttccatactccatacccgcaacattgttggtctggcacacttg

SEQ ID NO: 1161 - DNA, 60 bp, Artificial Sequence
  Synthetic oligonucleotide probe
gaaaaaattgagacctaggtggcttgatgcccgcacttattcagatccattggcactcaa

SEQ ID NO: 1162 - DNA, 60 bp, Artificial Sequence
  Synthetic oligonucleotide probe
tgggcaacgcaataatcaaattttagaggagaacatggatgtggaaatttggacaaagga

SEQ ID NO: 1163 - DNA, 60 bp, Artificial Sequence
  Synthetic oligonucleotide probe
gttagcccataaagtagcatcagaaggaatcaaatacacagatagaaaatggtgctttga

SEQ ID NO: 1164 - DNA, 60 bp, Artificial Sequence
  Synthetic oligonucleotide probe
acatcaacacaccagaagggattataccagctctctttgaaccagaaagggagaagtcag

SEQ ID NO: 1165 - DNA, 60 bp, Artificial Sequence
  Synthetic oligonucleotide probe
aaagagaatgaccagtacatattcacgggccagcctctcaacaatgatgaagaccatgct

SEQ ID NO: 1166 - DNA, 60 bp, Artificial Sequence
  Synthetic oligonucleotide probe
agatagagtgatcgacccaagaagatgtctcaaaccagtgatcttgacagatggaccaga

SEQ ID NO: 1167 - DNA, 60 bp, Artificial Sequence
  Synthetic oligonucleotide probe
gaatgattgggactttgtggtgacaactgacatttcagaaatgggggccaatttcaaagc

SEQ ID NO: 1168 - DNA, 60 bp, Artificial Sequence
  Synthetic oligonucleotide probe
cgggaaaaaagtcattcaacttagtaggaagacttttgacacagaatatcagaagactaa

SEQ ID NO: 1169 - DNA, 60 bp, Artificial Sequence
  Synthetic oligonucleotide probe
ggtgtggtttgtccctagcattaaagccggaaatgacatagcaaactgcttgcgaaaaaa

SEQ ID NO: 1170 - DNA, 60 bp, Artificial Sequence
  Synthetic oligonucleotide probe
acataccagaacgctcatggaattcaggcaatgaatggattaccgacttcgctgggaaaa

SEQ ID NO: 1171 - DNA, 60 bp, Artificial Sequence
  Synthetic oligonucleotide probe
gctatagtcctggagttttttatgatggtgttgctcataccagaaccagaaaagcagaga

SEQ ID NO: 1172 - DNA, 60 bp, Artificial Sequence
  Synthetic oligonucleotide probe
ggctatagtcctggagttttttatgatggtgttgctcataccagaaccagaaaagcagag

SEQ ID NO: 1173 - DNA, 60 bp, Artificial Sequence
  Synthetic oligonucleotide probe
cggctatagtcctggagttttttatgatggtgttgctcataccagaaccagaaaagcaga

SEQ ID NO: 1174 - DNA, 60 bp, Artificial Sequence
  Synthetic oligonucleotide probe
tcggctatagtcctggagttttttatgatggtgttgctcataccagaaccagaaaagcag

SEQ ID NO: 1175 - DNA, 60 bp, Artificial Sequence
  Synthetic oligonucleotide probe
gtcggctatagtcctggagttttttatgatggtgttgctcataccagaaccagaaaagca

SEQ ID NO: 1176 - DNA, 60 bp, Artificial Sequence
  Synthetic oligonucleotide probe
cgtcggctatagtcctggagttttttatgatggtgttgctcataccagaaccagaaaagc

SEQ ID NO: 1177 - DNA, 60 bp, Artificial Sequence
  Synthetic oligonucleotide probe
gcgtcggctatagtcctggagttttttatgatggtgttgctcataccagaaccagaaaag

SEQ ID NO: 1178 - DNA, 60 bp, Artificial Sequence
  Synthetic oligonucleotide probe
cgcgtcggctatagtcctggagttttttatgatggtgttgctcataccagaaccagaaaa

SEQ ID NO: 1179 - DNA, 60 bp, Artificial Sequence
  Synthetic oligonucleotide probe
tcgcgtcggctatagtcctggagttttttatgatggtgttgctcataccagaaccagaaa

SEQ ID NO: 1180 - DNA, 60 bp, Artificial Sequence
  Synthetic oligonucleotide probe
atcgcgtcggctatagtcctggagttttttatgatggtgttgctcataccagaaccagaa

SEQ ID NO: 1181 - DNA, 60 bp, Artificial Sequence
  Synthetic oligonucleotide probe
tatttagcaggagctgggcttgctttttctattatgaaatcagttggaacaggaaaaaga

SEQ ID NO: 1182 - DNA, 60 bp, Artificial Sequence
  Synthetic oligonucleotide probe
atcacctggtaagttctggaacaccacgatagctgtttccatggcgaacatttttagagg

SEQ ID NO: 1183 - DNA, 60 bp, Artificial Sequence
  Synthetic oligonucleotide probe
tcatgggccttgtgtgaagctttaactctagctacaggaccaataacaacactctgggaa

SEQ ID NO: 1184 - DNA, 60 bp, Artificial Sequence
  Synthetic oligonucleotide probe
tgaaaaacaactgggacaggttatgctcctggttttgtgcgcagtccaactcttgctaat

SEQ ID NO: 1185 - DNA, 60 bp, Artificial Sequence
  Synthetic oligonucleotide probe
gaagaatccaacagtggatgggataatgacaatagacctagattctgtaatatttgattc

SEQ ID NO: 1186 - DNA, 60 bp, Artificial Sequence
  Synthetic oligonucleotide probe
attatgctatcataggtccaggattgcaagcaaaagccacccgtgaagctcagaaaagga

SEQ ID NO: 1187 - DNA, 60 bp, Artificial Sequence
  Synthetic oligonucleotide probe
gttgctattcacaagtgaacccactgactctaactgcggcagtacttttgctaatcacac

SEQ ID NO: 1188 - DNA, 60 bp, Artificial Sequence
  Synthetic oligonucleotide probe
aaccaggcagtggtcctgatgggtttggacaaaggatggccaatatcaaaaatggactta

SEQ ID NO: 1189 - DNA, 60 bp, Artificial Sequence
  Synthetic oligonucleotide probe
ccaatgttaagacataccatagagaattctacagcaaatgtgtccctggcagctatagcc

SEQ ID NO: 1190 - DNA, 60 bp, Artificial Sequence
  Synthetic oligonucleotide probe
ttaggaatgtctaaggagccaggtgttgtttctccaaccagctatttggatgtggacttg

SEQ ID NO: 1191 - DNA, 60 bp, Artificial Sequence
  Synthetic oligonucleotide probe
aatgaagagttcctggactacatgccttcaatgaagagattcaggaaggaagaggagtcg

SEQ ID NO: 1192 - DNA, 60 bp, Artificial Sequence
  Synthetic oligonucleotide probe
taggaaagagagaagaccaatggtgtggatcacttattggtctcacttccagagcaacct

SEQ ID NO: 1193 - DNA, 60 bp, Artificial Sequence
  Synthetic oligonucleotide probe
aggaaaatccatggatggaagacaaaactccagttacaacttgggaaaatgttccatatc

SEQ ID NO: 1194 - DNA, 60 bp, Artificial Sequence
  Synthetic oligonucleotide probe
ttcatgctcaccatcagtggatgactacagaagacatgcttactgtttggaacagggtgt

SEQ ID NO: 1195 - DNA, 60 bp, Artificial Sequence
  Synthetic oligonucleotide probe
ttcacagaagagatctcagattagcatccaacgccatatgttcagcagtaccagtccact

SEQ ID NO: 1196 - DNA, 60 bp, Artificial Sequence
  Synthetic oligonucleotide probe
aactaataggaagagcaagaatctctcaaggagcgggatggagccttagagaaactgcat

SEQ ID NO: 1197 - DNA, 60 bp, Artificial Sequence
  Synthetic oligonucleotide probe
tttcatgaattgatcatgaaagatggaagaaagttggtggttccctgcagaccccaggac

SEQ ID NO: 1198 - DNA, 60 bp, Artificial Sequence
  Synthetic oligonucleotide probe
atatgggaaaggttcggaaagacatacctcaatggcagccatcaaagggatggcatgatt

SEQ ID NO: 1199 - DNA, 60 bp, Artificial Sequence
  Synthetic oligonucleotide probe
ttaaaaagaatggccattagcggggatgattgcgtggtgaaaccaatcgatgacaggttc

SEQ ID NO: 1200 - DNA, 60 bp, Artificial Sequence
  Synthetic oligonucleotide probe
aaccctcatctgctagagaagaaaatcacacaatggttggaaaccaaaggagtggagagg

SEQ ID NO: 1201 - DNA, 60 bp, Artificial Sequence
  Synthetic oligonucleotide probe
tcttgaacgggagaaaaaggtcaacgataacattgctgtgcttgattcccaccgtaatgg

SEQ ID NO: 1202 - DNA, 60 bp, Artificial Sequence
  Synthetic oligonucleotide probe
atcttgaacgggagaaaaaggtcaacgataacattgctgtgcttgattcccaccgtaatg

SEQ ID NO: 1203 - DNA, 60 bp, Artificial Sequence
  Synthetic oligonucleotide probe
catcttgaacgggagaaaaaggtcaacgataacattgctgtgcttgattcccaccgtaat

SEQ ID NO: 1204 - DNA, 60 bp, Artificial Sequence
  Synthetic oligonucleotide probe
acatcttgaacgggagaaaaaggtcaacgataacattgctgtgcttgattcccaccgtaa

SEQ ID NO: 1205 - DNA, 60 bp, Artificial Sequence
  Synthetic oligonucleotide probe
aacatcttgaacgggagaaaaaggtcaacgataacattgctgtgcttgattcccaccgta

SEQ ID NO: 1206 - DNA, 60 bp, Artificial Sequence
  Synthetic oligonucleotide probe
gaacatcttgaacgggagaaaaaggtcaacgataacattgctgtgcttgattcccaccgt

SEQ ID NO: 1207 - DNA, 60 bp, Artificial Sequence
  Synthetic oligonucleotide probe
tgaacatcttgaacgggagaaaaaggtcaacgataacattgctgtgcttgattcccaccg

SEQ ID NO: 1208 - DNA, 60 bp, Artificial Sequence
  Synthetic oligonucleotide probe
ctgaacatcttgaacgggagaaaaaggtcaacgataacattgctgtgcttgattcccacc

SEQ ID NO: 1209 - DNA, 60 bp, Artificial Sequence
  Synthetic oligonucleotide probe
gctgaacatcttgaacgggagaaaaaggtcaacgataacattgctgtgcttgattcccac

SEQ ID NO: 1210 - DNA, 60 bp, Artificial Sequence
  Synthetic oligonucleotide probe
tgctgaacatcttgaacgggagaaaaaggtcaacgataacattgctgtgcttgattccca

SEQ ID NO: 1211 - DNA, 60 bp, Artificial Sequence
  Synthetic oligonucleotide probe
cttatatgattgggcaaacaggaatccagcgaactgtcttctttgtcctaatgatgctgg

SEQ ID NO: 1212 - DNA, 60 bp, Artificial Sequence
  Synthetic oligonucleotide probe
gctcttggcaggatttatggcttatatgattgggcaaacaggaatccagcgaactgtctt

SEQ ID NO: 1213 - DNA, 60 bp, Artificial Sequence
  Synthetic oligonucleotide probe
tactcagaaacccaggattcgcgctcttggcaggatttatggcttatatgattgggcaaa

SEQ ID NO: 1214 - DNA, 60 bp, Artificial Sequence
  Synthetic oligonucleotide probe
ctttaacaccacattcaggaatgggattggaaacaagagctgagacatggatgtcatcgg

SEQ ID NO: 1215 - DNA, 60 bp, Artificial Sequence
  Synthetic oligonucleotide probe
agacgagagaagcgctcagtagctttaacaccacattcaggaatgggattggaaacaaga

SEQ ID NO: 1216 - DNA, 60 bp, Artificial Sequence
  Synthetic oligonucleotide probe
acactgtcacgtataaatgccccctactggtcaataccgaacctgaagacattgattgct

SEQ ID NO: 1217 - DNA, 60 bp, Artificial Sequence
  Synthetic oligonucleotide probe
caaatgcactctcattgccatggacttgggtgaaatgtgtgaggacactgtcacgtataa

SEQ ID NO: 1218 - DNA, 60 bp, Artificial Sequence
  Synthetic oligonucleotide probe
tttaagacaacagaggggatcaacaaatgcactctcattgccatggacttgggtgaaatg

SEQ ID NO: 1219 - DNA, 60 bp, Artificial Sequence
  Synthetic oligonucleotide probe
atgaaagggggagacctctcttgtttaagacaacagaggggatcaacaaatgcactctca

SEQ ID NO: 1220 - DNA, 60 bp, Artificial Sequence
  Synthetic oligonucleotide probe
aacccctcatgatagtggcaaaacatgaaagggggagacctctcttgtttaagacaacag

SEQ ID NO: 1221 - DNA, 60 bp, Artificial Sequence
  Synthetic oligonucleotide probe
aactcgaggaacacttcaatggctatgacgtgcatagctgttggaggaatcactctgttt

SEQ ID NO: 1222 - DNA, 60 bp, Artificial Sequence
  Synthetic oligonucleotide probe
ggaggagtctcatggatgattagaatcctaattgggttcttagtgttgtggattggcacg

SEQ ID NO: 1223 - DNA, 60 bp, Artificial Sequence
  Synthetic oligonucleotide probe
ttcacatcattgggaaaggctgtgcaccaggtttttggaagtgtgtatacaaccatgttt

SEQ ID NO: 1224 - DNA, 60 bp, Artificial Sequence
  Synthetic oligonucleotide probe
tacagaggtgcaaaacgaatggccattctaggtgaaacagcttgggattttggttccgtt

SEQ ID NO: 1225 - DNA, 60 bp, Artificial Sequence
  Synthetic oligonucleotide probe
gcattaacactccattggttcaggaaagggagttccattggcaagatgtttgagtccaca

SEQ ID NO: 1226 - DNA, 60 bp, Artificial Sequence
  Synthetic oligonucleotide probe
aacatagaattagaacccccctttggggacagctacatagtgataggtgttggaaacagc

SEQ ID NO: 1227 - DNA, 60 bp, Artificial Sequence
  Synthetic oligonucleotide probe
aaacaaggaaaaagtggttgggcgtatcatctcatccacccctttggctgagaataccaa

SEQ ID NO: 1228 - DNA, 60 bp, Artificial Sequence
  Synthetic oligonucleotide probe
gaaagtcaagtatgaaggtgctggagctccgtgtaaagtccccatagagataagagatgt

SEQ ID NO: 1229 - DNA, 60 bp, Artificial Sequence
  Synthetic oligonucleotide probe
ttcaggaaagttttcaattgacaaagagatggcagaaacacagcatgggacaacagtggt

SEQ ID NO: 1230 - DNA, 60 bp, Artificial Sequence
  Synthetic oligonucleotide probe
tcttaagtgcaaagtccgtatggagaaattgagaatcaagggaatgtcatacacgatgtg

SEQ ID NO: 1231 - DNA, 60 bp, Artificial Sequence
  Synthetic oligonucleotide probe
tgggatggagattaggcccttgagtgaaaaagaagagaacatggtcaaatcacaggtgac

SEQ ID NO: 1232 - DNA, 60 bp, Artificial Sequence
  Synthetic oligonucleotide probe
atagactttggagaatgccccggaacaacagtcacaattcaggaggattgtgaccataga

SEQ ID NO: 1233 - DNA, 60 bp, Artificial Sequence
  Synthetic oligonucleotide probe
tggaaagccagatgctcattccaaaatcatatgcgggccctttttcacagcacaattacc

SEQ ID NO: 1234 - DNA, 60 bp, Artificial Sequence
  Synthetic oligonucleotide probe
agaaagcatctcttattgaagtgaaaacatgtctgtggcccaagacccacacactgtgga

SEQ ID NO: 1235 - DNA, 60 bp, Artificial Sequence
  Synthetic oligonucleotide probe
tcagaaagctgtgcatgctgacatgggttattggatagagagctcaaaaaaccagacctg

SEQ ID NO: 1236 - DNA, 60 bp, Artificial Sequence
  Synthetic oligonucleotide probe
attccgagaaggaagttcagaagtgtgtgaccacaggttaatgtcagctgcaattaaaga

SEQ ID NO: 1237 - DNA, 60 bp, Artificial Sequence
  Synthetic oligonucleotide probe
gaactctcttgaggtggaagactatggatttggcatgttcacgaccaacatatggatgaa

SEQ ID NO: 1238 - DNA, 60 bp, Artificial Sequence
  Synthetic oligonucleotide probe
tagcacatttttaatagacggaccagacacctctgaatgccccaatgaacgaagagcatg

SEQ ID NO: 1239 - DNA, 60 bp, Artificial Sequence
  Synthetic oligonucleotide probe
tctgaaatattcatggaagacatggggaaaagcaaaaatcttcaccccagaagcaagaaa

SEQ ID NO: 1240 - DNA, 60 bp, Artificial Sequence
  Synthetic oligonucleotide probe
aaataaccaacgagctaaactatgttctctgggaaggaggacatgacctcactgtagtgg

SEQ ID NO: 1241 - DNA, 60 bp, Artificial Sequence
  Synthetic oligonucleotide probe
agaaataacagcactcatcctaggagcccaagctctgccagtgtacctaatgactcttat

SEQ ID NO: 1242 - DNA, 60 bp, Artificial Sequence
  Synthetic oligonucleotide probe
tgtgcaggacaagctgtcttcaaaaacagtctcattgggtagaaataacagcactcatcc

SEQ ID NO: 1243 - DNA, 60 bp, Artificial Sequence
  Synthetic oligonucleotide probe
accattatggctgtgttgtttgtggtcacactcattcctttgtgcaggacaagctgtctt

SEQ ID NO: 1244 - DNA, 60 bp, Artificial Sequence
  Synthetic oligonucleotide probe
tttcataagatcaacaatgccattggtcatggcttggaggaccattatggctgtgttgtt

SEQ ID NO: 1245 - DNA, 60 bp, Artificial Sequence
  Synthetic oligonucleotide probe
ttgacaacacccaagtgggaaccttagctctttccttgactttcataagatcaacaatgc

SEQ ID NO: 1246 - DNA, 60 bp, Artificial Sequence
  Synthetic oligonucleotide probe
atatcactgggactaattttgctaaaaatagtaacacagtttgacaacacccaagtggga

SEQ ID NO: 1247 - DNA, 60 bp, Artificial Sequence
  Synthetic oligonucleotide probe
gctttcaattccacatgaccttatggaactcattgatggaatatcactgggactaatttt

SEQ ID NO: 1248 - DNA, 60 bp, Artificial Sequence
  Synthetic oligonucleotide probe
agacagcactaatggtaataggaatggccatgacaacggtgctttcaattccacatgacc

SEQ ID NO: 1249 - DNA, 60 bp, Artificial Sequence
  Synthetic oligonucleotide probe
tacgtgctgggtgtgtttttaaggaaactcacttcaagagagacagcactaatggtaata

SEQ ID NO: 1250 - DNA, 60 bp, Artificial Sequence
  Synthetic oligonucleotide probe
acacatgatattagttgtggtgatcactctttgtgctatcatcctgggaggcctcacatg

SEQ ID NO: 1251 - DNA, 60 bp, Artificial Sequence
  Synthetic oligonucleotide probe
cccttggcaattccagtcacaatgaccttatggtacatgtggcaagtgaaaacacaaaga

SEQ ID NO: 1252 - DNA, 60 bp, Artificial Sequence
  Synthetic oligonucleotide probe
ccccttggcaattccagtcacaatgaccttatggtacatgtggcaagtgaaaacacaaag

SEQ ID NO: 1253 - DNA, 60 bp, Artificial Sequence
  Synthetic oligonucleotide probe
accccttggcaattccagtcacaatgaccttatggtacatgtggcaagtgaaaacacaaa

SEQ ID NO: 1254 - DNA, 60 bp, Artificial Sequence
  Synthetic oligonucleotide probe
taccccttggcaattccagtcacaatgaccttatggtacatgtggcaagtgaaaacacaa

SEQ ID NO: 1255 - DNA, 60 bp, Artificial Sequence
  Synthetic oligonucleotide probe
ctaccccttggcaattccagtcacaatgaccttatggtacatgtggcaagtgaaaacaca

SEQ ID NO: 1256 - DNA, 60 bp, Artificial Sequence
  Synthetic oligonucleotide probe
tctaccccttggcaattccagtcacaatgaccttatggtacatgtggcaagtgaaaacac

SEQ ID NO: 1257 - DNA, 60 bp, Artificial Sequence
  Synthetic oligonucleotide probe
ctctaccccttggcaattccagtcacaatgaccttatggtacatgtggcaagtgaaaaca

SEQ ID NO: 1258 - DNA, 60 bp, Artificial Sequence
  Synthetic oligonucleotide probe
tctctaccccttggcaattccagtcacaatgaccttatggtacatgtggcaagtgaaaac

SEQ ID NO: 1259 - DNA, 60 bp, Artificial Sequence
  Synthetic oligonucleotide probe
gtctctaccccttggcaattccagtcacaatgaccttatggtacatgtggcaagtgaaaa

SEQ ID NO: 1260 - DNA, 60 bp, Artificial Sequence
  Synthetic oligonucleotide probe
taacagtgtcaggtctctaccccttggcaattccagtcacaatgaccttatggtacatgt

SEQ ID NO: 1261 - DNA, 60 bp, Artificial Sequence
  Synthetic oligonucleotide probe
agatggttagatgcacgtgtatacgctgaccccatggctttgaaggatttcaaggagttt

SEQ ID NO: 1262 - DNA, 60 bp, Artificial Sequence
  Synthetic oligonucleotide probe
gggaatggtgcttcacaggggaaagaaataaccaaattttagaagaaaacatggaggttg

SEQ ID NO: 1263 - DNA, 60 bp, Artificial Sequence
  Synthetic oligonucleotide probe
aagacttttgtggaattaatgaggagaggagaccttccggtgtggctgagctataaggta

SEQ ID NO: 1264 - DNA, 60 bp, Artificial Sequence
  Synthetic oligonucleotide probe
attccaacattgtttggtccggaaagggaaaaaacccaagccattgatggagagtttcgc

SEQ ID NO: 1265 - DNA, 60 bp, Artificial Sequence
  Synthetic oligonucleotide probe
atgatgaagatcatgcccactggacagaagcaaagatgctgcttgacaatatctacaccc

SEQ ID NO: 1266 - DNA, 60 bp, Artificial Sequence
  Synthetic oligonucleotide probe
tttgtggtcactacagacatatctgaaatgggggccaattttagagccgggagagtgata

SEQ ID NO: 1267 - DNA, 60 bp, Artificial Sequence
  Synthetic oligonucleotide probe
cagttgagtaggaaaacctttgatacagagtatccaaaaacgaaactcacggactgggac

SEQ ID NO: 1268 - DNA, 60 bp, Artificial Sequence
  Synthetic oligonucleotide probe
ccagcataaaagctggaaatgacattgcaaattgtttgagaaagtcgggaaagaaagtta

SEQ ID NO: 1269 - DNA, 60 bp, Artificial Sequence
  Synthetic oligonucleotide probe
tcatggaacacagggttcgactggataacagactaccaagggaaaactgtgtggtttgtt

SEQ ID NO: 1270 - DNA, 60 bp, Artificial Sequence
  Synthetic oligonucleotide probe
tatagtgatggatgaagcacatttcaccgatccttctagtgtcgcggctagaggatacat

SEQ ID NO: 1271 - DNA, 60 bp, Artificial Sequence
  Synthetic oligonucleotide probe
tcaatcatactagagttttttctcatggtactgttgataccggaaccagaaaaacaaagg

SEQ ID NO: 1272 - DNA, 60 bp, Artificial Sequence
  Synthetic oligonucleotide probe
ctcaatcatactagagttttttctcatggtactgttgataccggaaccagaaaaacaaag

SEQ ID NO: 1273 - DNA, 60 bp, Artificial Sequence
  Synthetic oligonucleotide probe
cctcaatcatactagagttttttctcatggtactgttgataccggaaccagaaaaacaaa

SEQ ID NO: 1274 - DNA, 60 bp, Artificial Sequence
  Synthetic oligonucleotide probe
gcctcaatcatactagagttttttctcatggtactgttgataccggaaccagaaaaacaa

SEQ ID NO: 1275 - DNA, 60 bp, Artificial Sequence
  Synthetic oligonucleotide probe
ggcctcaatcatactagagttttttctcatggtactgttgataccggaaccagaaaaaca

SEQ ID NO: 1276 - DNA, 60 bp, Artificial Sequence
  Synthetic oligonucleotide probe
cggcctcaatcatactagagttttttctcatggtactgttgataccggaaccagaaaaac

SEQ ID NO: 1277 - DNA, 60 bp, Artificial Sequence
  Synthetic oligonucleotide probe
gcggcctcaatcatactagagttttttctcatggtactgttgataccggaaccagaaaaa

SEQ ID NO: 1278 - DNA, 60 bp, Artificial Sequence
  Synthetic oligonucleotide probe
agcggcctcaatcatactagagttttttctcatggtactgttgataccggaaccagaaaa

SEQ ID NO: 1279 - DNA, 60 bp, Artificial Sequence
  Synthetic oligonucleotide probe
tagcggcctcaatcatactagagttttttctcatggtactgttgataccggaaccagaaa

SEQ ID NO: 1280 - DNA, 60 bp, Artificial Sequence
  Synthetic oligonucleotide probe
atagcggcctcaatcatactagagttttttctcatggtactgttgataccggaaccagaa

SEQ ID NO: 1281 - DNA, 60 bp, Artificial Sequence
  Synthetic oligonucleotide probe
caacattttcaggggaagttacttggcgggagctggactggctttttcactcataaagaa

SEQ ID NO: 1282 - DNA, 60 bp, Artificial Sequence
  Synthetic oligonucleotide probe
tcttgatgagaacaacatgggctttctgtgaagtcttgactttggccacaggaccaatct

SEQ ID NO: 1283 - DNA, 60 bp, Artificial Sequence
  Synthetic oligonucleotide probe
tgctactagtcttgtgtgctggacaactactcttgatgagaacaacatgggctttctgtg

SEQ ID NO: 1284 - DNA, 60 bp, Artificial Sequence
  Synthetic oligonucleotide probe
ccaaaatttgaaaagcaattagggcaggtcatgctactagtcttgtgtgctggacaacta

SEQ ID NO: 1285 - DNA, 60 bp, Artificial Sequence
  Synthetic oligonucleotide probe
gtaatagatctagaaccaatatcctatgacccaaaatttgaaaagcaattagggcaggtc

SEQ ID NO: 1286 - DNA, 60 bp, Artificial Sequence
  Synthetic oligonucleotide probe
catgaaaaatcccacagtggacgggataacagtaatagatctagaaccaatatcctatga

SEQ ID NO: 1287 - DNA, 60 bp, Artificial Sequence
  Synthetic oligonucleotide probe
tcatgcttttagtccattatgcaataataggcccaggattgcaggcaaaagccacaagag

SEQ ID NO: 1288 - DNA, 60 bp, Artificial Sequence
  Synthetic oligonucleotide probe
tgaacccaacaaccttgacagcatccttagtcatgcttttagtccattatgcaataatag

SEQ ID NO: 1289 - DNA, 60 bp, Artificial Sequence
  Synthetic oligonucleotide probe
tttgggttttaccaggtaaaaacagaaaccaccatcctcgatgtggacttgagaccagct

SEQ ID NO: 1290 - DNA, 60 bp, Artificial Sequence
  Synthetic oligonucleotide probe
atggggctgattgaaaaaacaaaaacggattttgggttttaccaggtaaaaacagaaacc

SEQ ID NO: 1291 - DNA, 60 bp, Artificial Sequence
  Synthetic oligonucleotide probe
gtggattacatgccagtaatgaaaagatacagtgctccttcagagagtgaaggagttctg

SEQ ID NO: 1292 - DNA, 60 bp, Artificial Sequence
  Synthetic oligonucleotide probe
taccttacctagggaaaagagaggatttgtggtgtggatccctgattggactttcttcca

SEQ ID NO: 1293 - DNA, 60 bp, Artificial Sequence
  Synthetic oligonucleotide probe
tgtggatagaagacaaccctaatatgactgacaagactccagtccattcgtgggaagata

SEQ ID NO: 1294 - DNA, 60 bp, Artificial Sequence
  Synthetic oligonucleotide probe
aacaacatggtcaatccacgctcatcaccagtggatgaccactgaagatatgctcaaagt

SEQ ID NO: 1295 - DNA, 60 bp, Artificial Sequence
  Synthetic oligonucleotide probe
ttatgaaggatggccgctcactagttgttccatgtagaaaccaggatgaactgataggga

SEQ ID NO: 1296 - DNA, 60 bp, Artificial Sequence
  Synthetic oligonucleotide probe
ctaagggatggaaaaactggcaagaggttcctttttgctcccaccactttcacaagatct

SEQ ID NO: 1297 - DNA, 60 bp, Artificial Sequence
  Synthetic oligonucleotide probe
aaagagttgagaaatggctgaaagagtgtggtgtcgacaggttaaagaggatggcaatca

SEQ ID NO: 1298 - DNA, 60 bp, Artificial Sequence
  Synthetic oligonucleotide probe
aaatggaagctgaaggagtcatcacacaagatgacatgcagaacccaaaagggttgaaag

SEQ ID NO: 1299 - DNA, 60 bp, Artificial Sequence
  Synthetic oligonucleotide probe
gacaagttggaacatatggtttgaacacattcaccaacatggaagttcaactcatccgcc

SEQ ID NO: 1300 - DNA, 60 bp, Artificial Sequence
  Synthetic oligonucleotide probe
attttcaaactaacctatcaaaacaaagtggtgaaagtcctcagacccacaccgcgggga

SEQ ID NO: 1301 - DNA, 60 bp, Artificial Sequence
  Synthetic oligonucleotide probe
ttggtgccaggtgcatggtaactactacaagtttccactggacaaactgcctaacatcat

SEQ ID NO: 1302 - DNA, 60 bp, Artificial Sequence
  Synthetic oligonucleotide probe
tacatcaaggtgaaagctgcctgtgagagagtggggctgaaaaatgtctctcttctcata

SEQ ID NO: 1303 - DNA, 60 bp, Artificial Sequence
  Synthetic oligonucleotide probe
acttgaagggactccggtcccctttactcttactgtgaaaaaggaggtgttcttcaaaga

SEQ ID NO: 1304 - DNA, 60 bp, Artificial Sequence
  Synthetic oligonucleotide probe
ttggctctttgttagtggccgacactactaaggtgtatgttaccaatccagacaatgtgg

SEQ ID NO: 1305 - DNA, 60 bp, Artificial Sequence
  Synthetic oligonucleotide probe
ttgaatgtgacaagtgtgaggctaggcaagaaaccttggcctccttctcttacatttggt

SEQ ID NO: 1306 - DNA, 60 bp, Artificial Sequence
  Synthetic oligonucleotide probe
aaagtgtcttcaacgtggctctttccgtattaaaagccttatttccacagagcgacgcga

SEQ ID NO: 1307 - DNA, 60 bp, Artificial Sequence
  Synthetic oligonucleotide probe
tgatcactggtgacgttctgaatgggcaactcaaagaaccagtttactctaccaagctgt

SEQ ID NO: 1308 - DNA, 60 bp, Artificial Sequence
  Synthetic oligonucleotide probe
aggtcttcatgtatcccggacagttactttcagcaagttgactattgcgacaaggtctca

SEQ ID NO: 1309 - DNA, 60 bp, Artificial Sequence
  Synthetic oligonucleotide probe
ttgtattcagctaacaactctggcactaccacttggttgaaccgtctgctgactacgtta

SEQ ID NO: 1310 - DNA, 60 bp, Artificial Sequence
  Synthetic oligonucleotide probe
tattataggggtaaagacagttctatcatcaaggatggggacctggtggtctgtgctaca

SEQ ID NO: 1311 - DNA, 60 bp, Artificial Sequence
  Synthetic oligonucleotide probe
actactggattctggaatacctctggaaggtcccatttgatttctggagaggcgtgataa

SEQ ID NO: 1312 - DNA, 60 bp, Artificial Sequence
  Synthetic oligonucleotide probe
agtggtcgcgactcgaagatagatgtgtggagtttagtgccagttggctctgccacctgc

SEQ ID NO: 1313 - DNA, 60 bp, Artificial Sequence
  Synthetic oligonucleotide probe
tatgggtctgctacagtcacttgcgtgtggggttccgcttcttggtttgcctccaccagt

SEQ ID NO: 1314 - DNA, 60 bp, Artificial Sequence
  Synthetic oligonucleotide probe
cgggcaaaatcagtggcccctttcatgcccccagtatgtctatgggtctgctacagtcac

SEQ ID NO: 1315 - DNA, 60 bp, Artificial Sequence
  Synthetic oligonucleotide probe
ttgccaagcaatcggctggggtgaccccatcacttattggagccacgggcaaaatcagtg

SEQ ID NO: 1316 - DNA, 60 bp, Artificial Sequence
  Synthetic oligonucleotide probe
ttcgcgtttttcgactggggagaaggtgtgggaccgtgggaacgttacgcttcagtgtga

SEQ ID NO: 1317 - DNA, 60 bp, Artificial Sequence
  Synthetic oligonucleotide probe
ttgactacgggttgacttggcagacctgctcttgcagggccaacggttcgcgtttttcga

SEQ ID NO: 1318 - DNA, 60 bp, Artificial Sequence
  Synthetic oligonucleotide probe
tgcttgagcaacggattgtcatggtcttcctgttggtgacgatggccgggatgtcgcaag

SEQ ID NO: 1319 - DNA, 60 bp, Artificial Sequence
  Synthetic oligonucleotide probe
ataagcctgacccccttgttggtttgcgtggccgcattgctgctgcttgagcaacggatt

SEQ ID NO: 1320 - DNA, 60 bp, Artificial Sequence
  Synthetic oligonucleotide probe
gaaagtgagttttggagatggactgaacagctggcctccaactactggattctggaatac

SEQ ID NO: 1321 - DNA, 60 bp, Artificial Sequence
  Synthetic oligonucleotide probe
tttagatggttgggaccccaacgcctgatgttcctcgtgttgtggaagcttgctcgggga

SEQ ID NO: 1322 - DNA, 60 bp, Artificial Sequence
  Synthetic oligonucleotide probe
atattgggtttggcaaacctggtgctgtactttagatggttgggaccccaacgcctgatg

SEQ ID NO: 1323 - DNA, 60 bp, Artificial Sequence
  Synthetic oligonucleotide probe
tggtgtctgggactcccggtcgtcagtatgatattgggtttggcaaacctggtgctgtac

SEQ ID NO: 1324 - DNA, 60 bp, Artificial Sequence
  Synthetic oligonucleotide probe
tatacctgatgaagctggctgaggcacggttggtcccgctgatcttgctgctgctatggt

SEQ ID NO: 1325 - DNA, 60 bp, Artificial Sequence
  Synthetic oligonucleotide probe
ggttgctcttggactttgtatttgtcctgttatacctgatgaagctggctgaggcacggt

SEQ ID NO: 1326 - DNA, 60 bp, Artificial Sequence
  Synthetic oligonucleotide probe
atgcaggcaacttcatcccgcccccgcgctggttgctcttggactttgtatttgtcctgt

SEQ ID NO: 1327 - DNA, 60 bp, Artificial Sequence
  Synthetic oligonucleotide probe
tgggtttatacatgtccagggtcacttgcaggaggtggatgcaggcaacttcatcccgcc

SEQ ID NO: 1328 - DNA, 60 bp, Artificial Sequence
  Synthetic oligonucleotide probe
gtttgcatggctctcttcgggcaggcctgatgggtttatacatgtccagggtcacttgca

SEQ ID NO: 1329 - DNA, 60 bp, Artificial Sequence
  Synthetic oligonucleotide probe
tgttcgaagctgatgggaagccgaaatccggtttgtccggggtttgcatggctctcttcg

SEQ ID NO: 1330 - DNA, 60 bp, Artificial Sequence
  Synthetic oligonucleotide probe
atgaccaggatccgagataccctacatctggtggagtgtcccacaccagccattgagcct

SEQ ID NO: 1331 - DNA, 60 bp, Artificial Sequence
  Synthetic oligonucleotide probe
gaggttctcatcggcgtcttccaggatgtgaatcatttgcctcccgggtttgttccgacc

SEQ ID NO: 1332 - DNA, 60 bp, Artificial Sequence
  Synthetic oligonucleotide probe
tctgtcattcactaggacggactgtcgcatcatacgggatgccgcgaggactttgtcctg

SEQ ID NO: 1333 - DNA, 60 bp, Artificial Sequence
  Synthetic oligonucleotide probe
cctgttggaatgggacgcagctcttgaacctctgtcattcactaggacggactgtcgcat

SEQ ID NO: 1334 - DNA, 60 bp, Artificial Sequence
  Synthetic oligonucleotide probe
atgggctctttttcgcgtgctgtcaaggagcgcctgttggaatgggacgcagctcttgaa

SEQ ID NO: 1335 - DNA, 60 bp, Artificial Sequence
  Synthetic oligonucleotide probe
tgtgcgagaggagcttatttgttcgatcatatgggctctttttcgcgtgctgtcaaggag

SEQ ID NO: 1336 - DNA, 60 bp, Artificial Sequence
  Synthetic oligonucleotide probe
gccacaaccgtccggctggtctccaagatgtgtgcgagaggagcttatttgttcgatcat

SEQ ID NO: 1337 - DNA, 60 bp, Artificial Sequence
  Synthetic oligonucleotide probe
tggtccttctctttggcctgttcgacgcgttggattgggccttggaggagatcttggtgt

SEQ ID NO: 1338 - DNA, 60 bp, Artificial Sequence
  Synthetic oligonucleotide probe
cagatgctgtgatgatggtggtggttgccttggtccttctctttggcctgttcgacgcgt

SEQ ID NO: 1339 - DNA, 60 bp, Artificial Sequence
  Synthetic oligonucleotide probe
acctttgcctggtgcttggcctcgtacatctggccagatgctgtgatgatggtggtggtt

SEQ ID NO: 1340 - DNA, 60 bp, Artificial Sequence
  Synthetic oligonucleotide probe
tgatctataggacgtggtgtaaggggtaccaggcaatccgtcaaagggtggtgaggagcc

SEQ ID NO: 1341 - DNA, 60 bp, Artificial Sequence; identical to SEQ ID NO: 1310
  Synthetic oligonucleotide probe

SEQ ID NO: 1342 - DNA, 60 bp, Artificial Sequence
  Synthetic oligonucleotide probe
attgcctattataggggtaaagacagttctatcatcaaggatggggacctggtggtctgt

SEQ ID NO: 1343 - DNA, 60 bp, Artificial Sequence
  Synthetic oligonucleotide probe
aatgccattgcctattataggggtaaagacagttctatcatcaaggatggggacctggtg

SEQ ID NO: 1344 - DNA, 60 bp, Artificial Sequence
  Synthetic oligonucleotide probe
caatgccattgcctattataggggtaaagacagttctatcatcaaggatggggacctggt

SEQ ID NO: 1345 - DNA, 60 bp, Artificial Sequence
  Synthetic oligonucleotide probe
tcaatgccattgcctattataggggtaaagacagttctatcatcaaggatggggacctgg

SEQ ID NO: 1346 - DNA, 60 bp, Artificial Sequence
  Synthetic oligonucleotide probe
gtcaatgccattgcctattataggggtaaagacagttctatcatcaaggatggggacctg

SEQ ID NO: 1347 - DNA, 60 bp, Artificial Sequence
  Synthetic oligonucleotide probe
ggtcaatgccattgcctattataggggtaaagacagttctatcatcaaggatggggacct

SEQ ID NO: 1348 - DNA, 60 bp, Artificial Sequence
  Synthetic oligonucleotide probe
taggggggtcaatgccattgcctattataggggtaaagacagttctatcatcaaggatgg

SEQ ID NO: 1349 - DNA, 60 bp, Artificial Sequence
  Synthetic oligonucleotide probe
ctaggggggtcaatgccattgcctattataggggtaaagacagttctatcatcaaggatg

SEQ ID NO: 1350 - DNA, 60 bp, Artificial Sequence
  Synthetic oligonucleotide probe
gctaggggggtcaatgccattgcctattataggggtaaagacagttctatcatcaaggat

SEQ ID NO: 1351 - DNA, 60 bp, Artificial Sequence
  Synthetic oligonucleotide probe
aatgatctacgcgtcatacaccgggtcgctagtggtggtgacagactgggatgtgaaggg

SEQ ID NO: 1352 - DNA, 60 bp, Artificial Sequence
  Synthetic oligonucleotide probe
gaatgatctacgcgtcatacaccgggtcgctagtggtggtgacagactgggatgtgaagg

SEQ ID NO: 1353 - DNA, 60 bp, Artificial Sequence
  Synthetic oligonucleotide probe
ggaatgatctacgcgtcatacaccgggtcgctagtggtggtgacagactgggatgtgaag

SEQ ID NO: 1354 - DNA, 60 bp, Artificial Sequence
  Synthetic oligonucleotide probe
gggaatgatctacgcgtcatacaccgggtcgctagtggtggtgacagactgggatgtgaa

SEQ ID NO: 1355 - DNA, 60 bp, Artificial Sequence
  Synthetic oligonucleotide probe
ttgatgatcggtctagctatcgcggggggaatgatctacgcgtcatacaccgggtcgcta

SEQ ID NO: 1356 - DNA, 60 bp, Artificial Sequence
  Synthetic oligonucleotide probe
atcttgatgatcggtctagctatcgcggggggaatgatctacgcgtcatacaccgggtcg

SEQ ID NO: 1357 - DNA, 60 bp, Artificial Sequence
  Synthetic oligonucleotide probe
gatcttgatgatcggtctagctatcgcggggggaatgatctacgcgtcatacaccgggtc

SEQ ID NO: 1358 - DNA, 60 bp, Artificial Sequence
  Synthetic oligonucleotide probe
cgatcttgatgatcggtctagctatcgcggggggaatgatctacgcgtcatacaccgggt

SEQ ID NO: 1359 - DNA, 60 bp, Artificial Sequence
  Synthetic oligonucleotide probe
tgggccgatcttgatgatcggtctagctatcgcggggggaatgatctacgcgtcatacac

SEQ ID NO: 1360 - DNA, 60 bp, Artificial Sequence
  Synthetic oligonucleotide probe
ctgggccgatcttgatgatcggtctagctatcgcggggggaatgatctacgcgtcataca

SEQ ID NO: 1361 - DNA, 60 bp, Artificial Sequence; identical to SEQ ID NO: 1308
  Synthetic oligonucleotide probe

SEQ ID NO: 1362 - DNA, 60 bp, Artificial Sequence
  Synthetic oligonucleotide probe
aaggtcttcatgtatcccggacagttactttcagcaagttgactattgcgacaaggtctc

SEQ ID NO: 1363 - DNA, 60 bp, Artificial Sequence
  Synthetic oligonucleotide probe
caaggtcttcatgtatcccggacagttactttcagcaagttgactattgcgacaaggtct

SEQ ID NO: 1364 - DNA, 60 bp, Artificial Sequence
  Synthetic oligonucleotide probe
accaaggtcttcatgtatcccggacagttactttcagcaagttgactattgcgacaaggt

SEQ ID NO: 1365 - DNA, 60 bp, Artificial Sequence
  Synthetic oligonucleotide probe
taccaaggtcttcatgtatcccggacagttactttcagcaagttgactattgcgacaagg

SEQ ID NO: 1366 - DNA, 60 bp, Artificial Sequence
  Synthetic oligonucleotide probe
ttaccaaggtcttcatgtatcccggacagttactttcagcaagttgactattgcgacaag

SEQ ID NO: 1367 - DNA, 60 bp, Artificial Sequence
  Synthetic oligonucleotide probe
gttaccaaggtcttcatgtatcccggacagttactttcagcaagttgactattgcgacaa

SEQ ID NO: 1368 - DNA, 60 bp, Artificial Sequence
  Synthetic oligonucleotide probe
cgttaccaaggtcttcatgtatcccggacagttactttcagcaagttgactattgcgaca

SEQ ID NO: 1369 - DNA, 60 bp, Artificial Sequence
  Synthetic oligonucleotide probe
acgttaccaaggtcttcatgtatcccggacagttactttcagcaagttgactattgcgac

SEQ ID NO: 1370 - DNA, 60 bp, Artificial Sequence
  Synthetic oligonucleotide probe
tacgttaccaaggtcttcatgtatcccggacagttactttcagcaagttgactattgcga

SEQ ID NO: 1371 - DNA, 60 bp, Artificial Sequence
  Synthetic oligonucleotide probe
ttggtgggcaatgaacttacctttgaatgtgacaagtgtgaggctaggcaagaaaccttg

SEQ ID NO: 1372 - DNA, 60 bp, Artificial Sequence
  Synthetic oligonucleotide probe
cttggtgggcaatgaacttacctttgaatgtgacaagtgtgaggctaggcaagaaacctt

SEQ ID NO: 1373 - DNA, 60 bp, Artificial Sequence
  Synthetic oligonucleotide probe
tgaattgcaggttgggtgcttggtgggcaatgaacttacctttgaatgtgacaagtgtga

SEQ ID NO: 1374 - DNA, 60 bp, Artificial Sequence
  Synthetic oligonucleotide probe
ttgaattgcaggttgggtgcttggtgggcaatgaacttacctttgaatgtgacaagtgtg

SEQ ID NO: 1375 - DNA, 60 bp, Artificial Sequence
  Synthetic oligonucleotide probe
cttgaattgcaggttgggtgcttggtgggcaatgaacttacctttgaatgtgacaagtgt

SEQ ID NO: 1376 - DNA, 60 bp, Artificial Sequence; identical to SEQ ID NO: 1306
  Synthetic oligonucleotide probe

SEQ ID NO: 1377 - DNA, 60 bp, Artificial Sequence
  Synthetic oligonucleotide probe
aggaaagtgtcttcaacgtggctctttccgtattaaaagccttatttccacagagcgacg

SEQ ID NO: 1378 - DNA, 60 bp, Artificial Sequence
  Synthetic oligonucleotide probe
gaggaaagtgtcttcaacgtggctctttccgtattaaaagccttatttccacagagcgac

SEQ ID NO: 1379 - DNA, 60 bp, Artificial Sequence
  Synthetic oligonucleotide probe
ggaggaaagtgtcttcaacgtggctctttccgtattaaaagccttatttccacagagcga

SEQ ID NO: 1380 - DNA, 60 bp, Artificial Sequence
  Synthetic oligonucleotide probe
aggggaggaaagtgtcttcaacgtggctctttccgtattaaaagccttatttccacagag

SEQ ID NO: 1381 - DNA, 60 bp, Artificial Sequence; identical to SEQ ID NO: 1301
  Synthetic oligonucleotide probe

SEQ ID NO: 1382 - DNA, 60 bp, Artificial Sequence
  Synthetic oligonucleotide probe
tttggtgccaggtgcatggtaactactacaagtttccactggacaaactgcctaacatca

SEQ ID NO: 1383 - DNA, 60 bp, Artificial Sequence; identical to SEQ ID NO: 1302
  Synthetic oligonucleotide probe

SEQ ID NO: 1384 - DNA, 60 bp, Artificial Sequence; identical to SEQ ID NO: 1303
  Synthetic oligonucleotide probe

SEQ ID NO: 1385 - DNA, 60 bp, Artificial Sequence
  Synthetic oligonucleotide probe
tacttgaagggactccggtcccctttactcttactgtgaaaaaggaggtgttcttcaaag

SEQ ID NO: 1386 - DNA, 60 bp, Artificial Sequence
  Synthetic oligonucleotide probe
atacttgaagggactccggtcccctttactcttactgtgaaaaaggaggtgttcttcaaa

SEQ ID NO: 1387 - DNA, 60 bp, Artificial Sequence
  Synthetic oligonucleotide probe
gatacttgaagggactccggtcccctttactcttactgtgaaaaaggaggtgttcttcaa

SEQ ID NO: 1388 - DNA, 60 bp, Artificial Sequence
  Synthetic oligonucleotide probe
agatacttgaagggactccggtcccctttactcttactgtgaaaaaggaggtgttcttca

SEQ ID NO: 1389 - DNA, 60 bp, Artificial Sequence; identical to SEQ ID NO: 1304
  Synthetic oligonucleotide probe

SEQ ID NO: 1390 - DNA, 60 bp, Artificial Sequence
  Synthetic oligonucleotide probe
gttggctctttgttagtggccgacactactaaggtgtatgttaccaatccagacaatgtg

SEQ ID NO: 1391 - DNA, 60 bp, Artificial Sequence
  Synthetic oligonucleotide probe
aacatgtctagacaaggtattttccagactgttgggagtggtcttgaccacatcctgtct

SEQ ID NO: 1392 - DNA, 60 bp, Artificial Sequence
  Synthetic oligonucleotide probe
aggtactcaggggcatttaggtttttcctcattcttaaataataatgaacatgtctagac

SEQ ID NO: 1393 - DNA, 60 bp, Artificial Sequence
  Synthetic oligonucleotide probe
taattccagacctctctgtgcttagggcaaacatcatttggccttaaatgggattctgtg

SEQ ID NO: 1394 - DNA, 60 bp, Artificial Sequence
  Synthetic oligonucleotide probe
actctcatccagtggatgcattgagtggattgactgtcagggctgtctttaggcttaatt

SEQ ID NO: 1395 - DNA, 60 bp, Artificial Sequence
  Synthetic oligonucleotide probe
atattggtgagttgttaagacaaaaaccattcaacgccggaggactgactctcatccagt

SEQ ID NO: 1396 - DNA, 60 bp, Artificial Sequence
  Synthetic oligonucleotide probe
cttctatgaagagatgccttggatagggtaacagcggcggatattggtgagttgttaaga

SEQ ID NO: 1397 - DNA, 60 bp, Artificial Sequence
  Synthetic oligonucleotide probe
tgatcttccacaaggggtaggctacgggtgaaacctcttaggctaatacttctatgaaga

SEQ ID NO: 1398 - DNA, 60 bp, Artificial Sequence
  Synthetic oligonucleotide probe
cgtcaccttgcagtgttaacttggctttcatgaatctctttgatcttccacaaggggtag

SEQ ID NO: 1399 - DNA, 60 bp, Artificial Sequence
  Synthetic oligonucleotide probe
atgattagcatggagctgtaggagtctaaattggggacacagatgtttggaacgtcacct

SEQ ID NO: 1400 - DNA, 60 bp, Artificial Sequence
  Synthetic oligonucleotide probe
gcaggttcagggttcttaaatctgtttctctataagaacactcatttttcacgctttctg

SEQ ID NO: 1401 - DNA, 60 bp, Artificial Sequence
  Synthetic oligonucleotide probe
caatgttttagctagatttacagatttggagttgcatggattaactcctctttctacaca

SEQ ID NO: 1402 - DNA, 60 bp, Artificial Sequence
  Synthetic oligonucleotide probe
gacaattagagtttggtcagaattaaatattgggacaggaacttcagcttatacttcact

SEQ ID NO: 1403 - DNA, 60 bp, Artificial Sequence
  Synthetic oligonucleotide probe
atttatttacacaagaggtgcttaccactttaaagatccacaatacccagtttgggaatt

SEQ ID NO: 1404 - DNA, 60 bp, Artificial Sequence
  Synthetic oligonucleotide probe
cagagctatggttctatagcatcattgactgtttatcctcatggtttgttaaattgcaat

SEQ ID NO: 1405 - DNA, 60 bp, Artificial Sequence
  Synthetic oligonucleotide probe
ttcaagttcagataaaccctacacctttccaacaggggggattgatctgtgctatggttc

SEQ ID NO: 1406 - DNA, 60 bp, Artificial Sequence
  Synthetic oligonucleotide probe
agcagtttgctgttcaagggttgttgagataccatacatatgcaagatttggcattgaaa

SEQ ID NO: 1407 - DNA, 60 bp, Artificial Sequence
  Synthetic oligonucleotide probe
ggcttactacacatgctcttttccatgaagttgcaaaattggatgtggtgaaattattat

SEQ ID NO: 1408 - DNA, 60 bp, Artificial Sequence
  Synthetic oligonucleotide probe
ataaacccggttcaaagaagactcagggagagaaatttttcttgattcattctgcagatt

SEQ ID NO: 1409 - DNA, 60 bp, Artificial Sequence
  Synthetic oligonucleotide probe
tcttcagttcatacagctgaggttggatcacaccaggttgaacctttgagaacctctgtt

SEQ ID NO: 1410 - DNA, 60 bp, Artificial Sequence
  Synthetic oligonucleotide probe
attcaatcagttgataggactgcagtgactggtgcttcttattttacttctgtggatcaa

SEQ ID NO: 1411 - DNA, 60 bp, Artificial Sequence
  Synthetic oligonucleotide probe
tcagcaattaacttggaatgttttgctcctctttatcatgctatggatgttactacacaa

SEQ ID NO: 1412 - DNA, 60 bp, Artificial Sequence
  Synthetic oligonucleotide probe
tataacagattgacctctccttctaacgttgcttcccatgtcagagtgaatgtttatctt

SEQ ID NO: 1413 - DNA, 60 bp, Artificial Sequence
  Synthetic oligonucleotide probe
acaaagtcagcacatcagaaaggtgagtacactgccattgggaagcttattgtgtattgt

SEQ ID NO: 1414 - DNA, 60 bp, Artificial Sequence
  Synthetic oligonucleotide probe
tcaactttgagatttcgtgttccctggatttctgacactccttacagagtgaacaggtat

SEQ ID NO: 1415 - DNA, 60 bp, Artificial Sequence
  Synthetic oligonucleotide probe
atcacattaaagcaagcaactactgctccttgtgcagtaatggatattacaggagtgcag

SEQ ID NO: 1416 - DNA, 60 bp, Artificial Sequence
  Synthetic oligonucleotide probe
cattcaggtagattactgttttgttttgttcctggcaatgagctaatagatgtttctgga

SEQ ID NO: 1417 - DNA, 60 bp, Artificial Sequence
  Synthetic oligonucleotide probe
cagatgttttgtttttggagaggagatcttgtctttgattttcaagtttttcccaccaaa

SEQ ID NO: 1418 - DNA, 60 bp, Artificial Sequence
  Synthetic oligonucleotide probe
cccatattttttccaaatgacaaatacgaatcctgaccaaaaatgtataactgctttggc

SEQ ID NO: 1419 - DNA, 60 bp, Artificial Sequence
  Synthetic oligonucleotide probe
ctcagtttccatttaatgcttcagactcagttggtcaacaaattaaagttattccagttg

SEQ ID NO: 1420 - DNA, 60 bp, Artificial Sequence
  Synthetic oligonucleotide probe
agggtggtgggatcaaaattactcattttactacttggacatctattccaactttggctg

SEQ ID NO: 1421 - DNA, 60 bp, Artificial Sequence
  Synthetic oligonucleotide probe
gctggagacttggagtcatcagtggatgatcctagatcagaggaagataaaagatttgag

SEQ ID NO: 1422 - DNA, 60 bp, Artificial Sequence
  Synthetic oligonucleotide probe
agagctccattgaactcaaatgccatgttatccactgaatcaatgatgagcagaattgca

SEQ ID NO: 1423 - DNA, 60 bp, Artificial Sequence
  Synthetic oligonucleotide probe
gggtgacaagacagattctacatttggattggtttctattcagattgcaaattacaatca

SEQ ID NO: 1424 - DNA, 60 bp, Artificial Sequence
  Synthetic oligonucleotide probe
tcagattagattaccatggtattcttatttatatgctgtgtctggagcactggatggttt

SEQ ID NO: 1425 - DNA, 60 bp, Artificial Sequence
  Synthetic oligonucleotide probe
tattgactacaaaactgctcttggagctgtcagatttaacacaaggagaacagggaacat

SEQ ID NO: 1426 - DNA, 60 bp, Artificial Sequence
  Synthetic oligonucleotide probe
ttattattacaggagcaactgatgtagatggcatggcctggttcactccagtaggtcttg

SEQ ID NO: 1427 - DNA, 60 bp, Artificial Sequence
  Synthetic oligonucleotide probe
caacactgaggtggtttttcaacttgtttcagttgtatagagggcctttagatctgacaa

SEQ ID NO: 1428 - DNA, 60 bp, Artificial Sequence
  Synthetic oligonucleotide probe
aagagtacacatttcctataaccttgtcttcaacctctaatcctcctcatggtttgccat

SEQ ID NO: 1429 - DNA, 60 bp, Artificial Sequence
  Synthetic oligonucleotide probe
gtccatctacaagtttatgggaaggtctcatttcttgtgcacttttacattcaattcaaa

SEQ ID NO: 1430 - DNA, 60 bp, Artificial Sequence
  Synthetic oligonucleotide probe
agtacctgagacatttcctgaattgaaacctggagaatccagacatacatcagatcatat

SEQ ID NO: 1431 - DNA, 60 bp, Artificial Sequence
  Synthetic oligonucleotide probe
ggttaaatccaaagaaaattaatttagcagatagaatgcttggattgtctggagttcagg

SEQ ID NO: 1432 - DNA, 60 bp, Artificial Sequence
  Synthetic oligonucleotide probe
ttcctaacatgtctgaaacggatttgtgtttcttgctgcattggttaaatccaaagaaaa

SEQ ID NO: 1433 - DNA, 60 bp, Artificial Sequence
  Synthetic oligonucleotide probe
atgttggatcttgaagaaattgctgccaattctaaggattttcctaacatgtctgaaacg

SEQ ID NO: 1434 - DNA, 60 bp, Artificial Sequence
  Synthetic oligonucleotide probe
aagtaacaaatattggtccaaagtgaatttcccacatgggatgttggatcttgaagaaat

SEQ ID NO: 1435 - DNA, 60 bp, Artificial Sequence
  Synthetic oligonucleotide probe
gggttcttactgggagactgattagattgaatgatgagaaatggacagaaatgaaggatg

SEQ ID NO: 1436 - DNA, 60 bp, Artificial Sequence
  Synthetic oligonucleotide probe
agttttcctggagaggtgtgactgctgatactagagctttaaggaggtttggattctctt

SEQ ID NO: 1437 - DNA, 60 bp, Artificial Sequence
  Synthetic oligonucleotide probe
gccaaaatttctcttttttatactgaggagcatgaaataatgaagttttcctggagaggt

SEQ ID NO: 1438 - DNA, 60 bp, Artificial Sequence
  Synthetic oligonucleotide probe
acttccaccccctaggaaaatgaagggactgttttcacaagccaaaatttctctttttta

SEQ ID NO: 1439 - DNA, 60 bp, Artificial Sequence
  Synthetic oligonucleotide probe
aaagactcaagtatgctcaggaagaattgtcaaatgaagtacttccaccccctaggaaaa

SEQ ID NO: 1440 - DNA, 60 bp, Artificial Sequence
  Synthetic oligonucleotide probe
aggaagccatataaagaactgagattagaagttgggaaacaaagactcaagtatgctcag

SEQ ID NO: 1441 - DNA, 60 bp, Artificial Sequence
  Synthetic oligonucleotide probe
atgctggaaacagtctttaattggcaaatggactccagaatgatggagttaaggactcag

SEQ ID NO: 1442 - DNA, 60 bp, Artificial Sequence
  Synthetic oligonucleotide probe
aatgctggaaacagtctttaattggcaaatggactccagaatgatggagttaaggactca

SEQ ID NO: 1443 - DNA, 60 bp, Artificial Sequence
  Synthetic oligonucleotide probe
aaatgctggaaacagtctttaattggcaaatggactccagaatgatggagttaaggactc

SEQ ID NO: 1444 - DNA, 60 bp, Artificial Sequence
  Synthetic oligonucleotide probe
caaaatgctggaaacagtctttaattggcaaatggactccagaatgatggagttaaggac

SEQ ID NO: 1445 - DNA, 60 bp, Artificial Sequence
  Synthetic oligonucleotide probe
ccaaaatgctggaaacagtctttaattggcaaatggactccagaatgatggagttaagga

SEQ ID NO: 1446 - DNA, 60 bp, Artificial Sequence
  Synthetic oligonucleotide probe
tccaaaatgctggaaacagtctttaattggcaaatggactccagaatgatggagttaagg

SEQ ID NO: 1447 - DNA, 60 bp, Artificial Sequence
  Synthetic oligonucleotide probe
ttccaaaatgctggaaacagtctttaattggcaaatggactccagaatgatggagttaag

SEQ ID NO: 1448 - DNA, 60 bp, Artificial Sequence
  Synthetic oligonucleotide probe
tttccaaaatgctggaaacagtctttaattggcaaatggactccagaatgatggagttaa

SEQ ID NO: 1449 - DNA, 60 bp, Artificial Sequence
  Synthetic oligonucleotide probe
ttttccaaaatgctggaaacagtctttaattggcaaatggactccagaatgatggagtta

SEQ ID NO: 1450 - DNA, 60 bp, Artificial Sequence
  Synthetic oligonucleotide probe
tttttccaaaatgctggaaacagtctttaattggcaaatggactccagaatgatggagtt

SEQ ID NO: 1451 - DNA, 60 bp, Artificial Sequence
  Synthetic oligonucleotide probe
gtcatgacagttgaaattagaaaacaaaacatgactgaattcatggagttgtggtctcag

SEQ ID NO: 1452 - DNA, 60 bp, Artificial Sequence
  Synthetic oligonucleotide probe
gtcttgtgttgatttgataatggatggacataatgtttcattgatggatttgctcagttc

SEQ ID NO: 1453 - DNA, 60 bp, Artificial Sequence
  Synthetic oligonucleotide probe
cagactccatttcaaggttgaagttaaacctgcttcatttttcaaaaatcctcacaatga

SEQ ID NO: 1454 - DNA, 60 bp, Artificial Sequence
  Synthetic oligonucleotide probe
aacttcaaattggtcaaatccaagtccaaaaacagtttatgttaaggaagcaattgaccg

SEQ ID NO: 1455 - DNA, 60 bp, Artificial Sequence
  Synthetic oligonucleotide probe
attaaacatggcctctcttgaggagaagggtaggcatttttcttctccttttataatagc

SEQ ID NO: 1456 - DNA, 60 bp, Artificial Sequence
  Synthetic oligonucleotide probe
aaacacaacagatgaggattggtcagatttttgtcagttagtgtcaggatgtccaatgag

SEQ ID NO: 1457 - DNA, 60 bp, Artificial Sequence
  Synthetic oligonucleotide probe
ttcagattactgggatggatatagtggacaattagtttgcatcattgatgatattggcca

SEQ ID NO: 1458 - DNA, 60 bp, Artificial Sequence
  Synthetic oligonucleotide probe
gcttaacatcaattgcattggcaaccaaaatttgtaaacattatggtgttgagcctgaaa

SEQ ID NO: 1459 - DNA, 60 bp, Artificial Sequence
  Synthetic oligonucleotide probe
tggtaacgagatgtgagccagttgtttgttatttatatggcaaaagagggggaggaaaga

SEQ ID NO: 1460 - DNA, 60 bp, Artificial Sequence
  Synthetic oligonucleotide probe
gagagattgtatagcaagagttcatcagaaacttaaaaaccttggatctataaatcaggc

SEQ ID NO: 1461 - DNA, 60 bp, Artificial Sequence
  Synthetic oligonucleotide probe
ttttccaatctgttactaatcacaagtgggttgctgtgggagctgcagttggcattcttg

SEQ ID NO: 1462 - DNA, 60 bp, Artificial Sequence
  Synthetic oligonucleotide probe
tttttccaatctgttactaatcacaagtgggttgctgtgggagctgcagttggcattctt

SEQ ID NO: 1463 - DNA, 60 bp, Artificial Sequence
  Synthetic oligonucleotide probe
ctttttccaatctgttactaatcacaagtgggttgctgtgggagctgcagttggcattct

SEQ ID NO: 1464 - DNA, 60 bp, Artificial Sequence
  Synthetic oligonucleotide probe
tatctggctttttccaatctgttactaatcacaagtgggttgctgtgggagctgcagttg

SEQ ID NO: 1465 - DNA, 60 bp, Artificial Sequence
  Synthetic oligonucleotide probe
ttatctggctttttccaatctgttactaatcacaagtgggttgctgtgggagctgcagtt

SEQ ID NO: 1466 - DNA, 60 bp, Artificial Sequence
  Synthetic oligonucleotide probe
attatctggctttttccaatctgttactaatcacaagtgggttgctgtgggagctgcagt

SEQ ID NO: 1467 - DNA, 60 bp, Artificial Sequence
  Synthetic oligonucleotide probe
aattatctggctttttccaatctgttactaatcacaagtgggttgctgtgggagctgcag

SEQ ID NO: 1468 - DNA, 60 bp, Artificial Sequence
  Synthetic oligonucleotide probe
aaattatctggctttttccaatctgttactaatcacaagtgggttgctgtgggagctgca

SEQ ID NO: 1469 - DNA, 60 bp, Artificial Sequence
  Synthetic oligonucleotide probe
taaattatctggctttttccaatctgttactaatcacaagtgggttgctgtgggagctgc

SEQ ID NO: 1470 - DNA, 60 bp, Artificial Sequence
  Synthetic oligonucleotide probe
ctaaattatctggctttttccaatctgttactaatcacaagtgggttgctgtgggagctg

SEQ ID NO: 1471 - DNA, 60 bp, Artificial Sequence
  Synthetic oligonucleotide probe
catggtgtaactaagcccaagcaagtgattaaattagatgcagatccagtagaatctcag

SEQ ID NO: 1472 - DNA, 60 bp, Artificial Sequence
  Synthetic oligonucleotide probe
tcatggtgtaactaagcccaagcaagtgattaaattagatgcagatccagtagaatctca

SEQ ID NO: 1473 - DNA, 60 bp, Artificial Sequence
  Synthetic oligonucleotide probe
atcatggtgtaactaagcccaagcaagtgattaaattagatgcagatccagtagaatctc

SEQ ID NO: 1474 - DNA, 60 bp, Artificial Sequence
  Synthetic oligonucleotide probe
tatcatggtgtaactaagcccaagcaagtgattaaattagatgcagatccagtagaatct

SEQ ID NO: 1475 - DNA, 60 bp, Artificial Sequence
  Synthetic oligonucleotide probe
atatcatggtgtaactaagcccaagcaagtgattaaattagatgcagatccagtagaatc

SEQ ID NO: 1476 - DNA, 60 bp, Artificial Sequence
  Synthetic oligonucleotide probe
tatatcatggtgtaactaagcccaagcaagtgattaaattagatgcagatccagtagaat

SEQ ID NO: 1477 - DNA, 60 bp, Artificial Sequence
  Synthetic oligonucleotide probe
gtatatcatggtgtaactaagcccaagcaagtgattaaattagatgcagatccagtagaa

SEQ ID NO: 1478 - DNA, 60 bp, Artificial Sequence
  Synthetic oligonucleotide probe
ggtatatcatggtgtaactaagcccaagcaagtgattaaattagatgcagatccagtaga

SEQ ID NO: 1479 - DNA, 60 bp, Artificial Sequence
  Synthetic oligonucleotide probe
gggtatatcatggtgtaactaagcccaagcaagtgattaaattagatgcagatccagtag

SEQ ID NO: 1480 - DNA, 60 bp, Artificial Sequence
  Synthetic oligonucleotide probe
ggggtatatcatggtgtaactaagcccaagcaagtgattaaattagatgcagatccagta

SEQ ID NO: 1481 - DNA, 60 bp, Artificial Sequence
  Synthetic oligonucleotide probe
atccatgttgctggaggaaattcaattcttgttgcaaaattggttactcaagaaatgttc

SEQ ID NO: 1482 - DNA, 60 bp, Artificial Sequence
  Synthetic oligonucleotide probe
ggtttcatcgaatcaatctatacagaatgcaatcttgggcatccatgttgctggaggaaa

SEQ ID NO: 1483 - DNA, 60 bp, Artificial Sequence
  Synthetic oligonucleotide probe
tgatggtacaacagttgatttaactgtggatcaggcatggagaggaaaaggcgaaggtct

SEQ ID NO: 1484 - DNA, 60 bp, Artificial Sequence
  Synthetic oligonucleotide probe
gggcccactaaagatggaagagaaagctacttatgttcataagaaaaatgatggtacaac

SEQ ID NO: 1485 - DNA, 60 bp, Artificial Sequence
  Synthetic oligonucleotide probe
tagtgacaactgtaaatggaacccctatgttaatttctgagggcccactaaagatggaag

SEQ ID NO: 1486 - DNA, 60 bp, Artificial Sequence
  Synthetic oligonucleotide probe
aagaaaggggatgtgcctagagctttgaatcgcctggcaacattagtgacaactgtaaat

SEQ ID NO: 1487 - DNA, 60 bp, Artificial Sequence
  Synthetic oligonucleotide probe
tcctacaattcctaagtttagagatattactcagcattttattaagaaaggggatgtgcc

SEQ ID NO: 1488 - DNA, 60 bp, Artificial Sequence
  Synthetic oligonucleotide probe
ctttggatgtgggattccaggatgttgttctgatgaaggttcctacaattcctaagttta

SEQ ID NO: 1489 - DNA, 60 bp, Artificial Sequence
  Synthetic oligonucleotide probe
acttactattcaatttcagctggtaatgttgttattcaatctttggatgtgggattccag

SEQ ID NO: 1490 - DNA, 60 bp, Artificial Sequence
  Synthetic oligonucleotide probe
ttggctgcttgtgccttcccatgcttataaatttgagaaagattatgaaatgatggagtt

SEQ ID NO: 1491 - DNA, 60 bp, Artificial Sequence
  Synthetic oligonucleotide probe
gacttaaatcttatgattggtggagaatgagattttatgaccagtgtttcatttgtgacc

SEQ ID NO: 1492 - DNA, 60 bp, Artificial Sequence
  Synthetic oligonucleotide probe
gcagaatttagaaaatgctcagtggtttgcttttatgcatggctatgagttttatcagaa

SEQ ID NO: 1493 - DNA, 60 bp, Artificial Sequence
  Synthetic oligonucleotide probe
aatttcggaaaaaacaatttggtctttaatagcatggcagagaagtaacgctgagtttga

SEQ ID NO: 1494 - DNA, 60 bp, Artificial Sequence
  Synthetic oligonucleotide probe
ttcggaattgacttttctcaaaagatctttcaatttggtagaggatagaattagacctgc

SEQ ID NO: 1495 - DNA, 60 bp, Artificial Sequence
  Synthetic oligonucleotide probe
taagaaacttggcatgacagctacttctgctgacaagaatgtacctcagctgaaaccagt

SEQ ID NO: 1496 - DNA, 60 bp, Artificial Sequence
  Synthetic oligonucleotide probe
gctttgaagattctctgttatggagatgatgttttaatagttttctctcgagatgttcag

SEQ ID NO: 1497 - DNA, 60 bp, Artificial Sequence
  Synthetic oligonucleotide probe
gccctctgggtctccttgtacagctttgctaaattcaattattaataatgtcaatttgta

SEQ ID NO: 1498 - DNA, 60 bp, Artificial Sequence
  Synthetic oligonucleotide probe
caatactatcatttattccaagcatttgctgtataactgttgttaccatgtctgtggttc

SEQ ID NO: 1499 - DNA, 60 bp, Artificial Sequence
  Synthetic oligonucleotide probe
agcaggtagaatcatgagtgaactatctggaactccatcccattttggcacagctcttat

SEQ ID NO: 1500 - DNA, 60 bp, Artificial Sequence
  Synthetic oligonucleotide probe
gagatgttggtcttgatttagatttctctgcttttgatgctagtcttagtccatttatga

SEQ ID NO: 1501 - DNA, 60 bp, Artificial Sequence
  Synthetic oligonucleotide probe
tttctccgcaagctcacgaatgtagctcagatgtgtgtggatgttgtctctcgtgtttat

SEQ ID NO: 1502 - DNA, 60 bp, Artificial Sequence
  Synthetic oligonucleotide probe
tctatggaatacagtctggaacatggccgttatcacccactgttatgatttccgcgatct

SEQ ID NO: 1503 - DNA, 60 bp, Artificial Sequence
  Synthetic oligonucleotide probe
ttccacccagaataatttttccttgggcctagagtgtgctattatggtggagtgtgggat

SEQ ID NO: 1504 - DNA, 60 bp, Artificial Sequence
  Synthetic oligonucleotide probe
ttcttccagaaagattgtaataaattcaccacgggggagaccatcgcccatggtaaagtg

SEQ ID NO: 1505 - DNA, 60 bp, Artificial Sequence
  Synthetic oligonucleotide probe
tgatagtgtcgtaacatttgaattaacagatattgtgcactgtcgtatggccgccccgag

SEQ ID NO: 1506 - DNA, 60 bp, Artificial Sequence
  Synthetic oligonucleotide probe
aatcgttaataactttttccttgctggtggcgaaattggccaccagcgcccatctgttat

SEQ ID NO: 1507 - DNA, 60 bp, Artificial Sequence
  Synthetic oligonucleotide probe
actctcactataactgaggatgttgcacggacagcaaatctggctatcgaacttgactca

SEQ ID NO: 1508 - DNA, 60 bp, Artificial Sequence
  Synthetic oligonucleotide probe
ataattcacgccgtcgctcctgattataggttggaacataacccaaagatgcttgaggct

SEQ ID NO: 1509 - DNA, 60 bp, Artificial Sequence
  Synthetic oligonucleotide probe
tgtttctagtccagcccagcccgacttaggttttatatctgagccttctatacctagtag

SEQ ID NO: 1510 - DNA, 60 bp, Artificial Sequence
  Synthetic oligonucleotide probe
agaagtttataacacgcctctacagttggctctttgagaagtccggccgtgattatatcc

SEQ ID NO: 1511 - DNA, 60 bp, Artificial Sequence
  Synthetic oligonucleotide probe
tctctctcaccagcagattgagatccttattaacctaatgcaacctcgccagcttgtttt

SEQ ID NO: 1512 - DNA, 60 bp, Artificial Sequence
  Synthetic oligonucleotide probe
accaagccttttgctgctcccgcctaatgacttacctccgtggcattagctacaaggtta

SEQ ID NO: 1513 - DNA, 60 bp, Artificial Sequence
  Synthetic oligonucleotide probe
actaagtcgaccttccatgctgtccctgcccatatctgggaccgtctcatgttgttcggg

SEQ ID NO: 1514 - DNA, 60 bp, Artificial Sequence
  Synthetic oligonucleotide probe
atcctctcgtcattgagcgggttagggccattggctgccactttgtcctcttactcacgg

SEQ ID NO: 1515 - DNA, 60 bp, Artificial Sequence
  Synthetic oligonucleotide probe
ataaccacgatgtttccaacctgcgctcctggattagaaccactaaggttaccggagacc

SEQ ID NO: 1516 - DNA, 60 bp, Artificial Sequence
  Synthetic oligonucleotide probe
tacttgctgatccatgacggcaggcgcgttgtggtgacgtatgagggtgacactagtgct

SEQ ID NO: 1517 - DNA, 60 bp, Artificial Sequence
  Synthetic oligonucleotide probe
atgtcaccatctgatgtcgccgaggctatgttccgccatggtatgacgcggctttacgct

SEQ ID NO: 1518 - DNA, 60 bp, Artificial Sequence
  Synthetic oligonucleotide probe
gggttttctggctgtaactttcccgccgagactggcgtcgccctctattctctccatgat

SEQ ID NO: 1519 - DNA, 60 bp, Artificial Sequence
  Synthetic oligonucleotide probe
ataaatgataaccctaatgtggtccaccgctgcttcctccgccctgccgggcgtgatgtt

SEQ ID NO: 1520 - DNA, 60 bp, Artificial Sequence
  Synthetic oligonucleotide probe
atccataatgagctggagctttactgtcgcgcccgttccggccgctgccttgaaattggt

SEQ ID NO: 1521 - DNA, 60 bp, Artificial Sequence
  Synthetic oligonucleotide probe
cgtcgtttgttgacggggcggttttagagactaatggcccagagcgccacaatctctctt

SEQ ID NO: 1522 - DNA, 60 bp, Artificial Sequence
  Synthetic oligonucleotide probe
cggtaataaaaccttccgcacgtcgtttgttgacggggcggttttagagactaatggccc

SEQ ID NO: 1523 - DNA, 60 bp, Artificial Sequence
  Synthetic oligonucleotide probe
atcgattgtgagacccttctcggtaataaaaccttccgcacgtcgtttgttgacggggcg

SEQ ID NO: 1524 - DNA, 60 bp, Artificial Sequence
  Synthetic oligonucleotide probe
tctcccaggtcgacgggcggatcgattgtgagacccttctcggtaataaaaccttccgca

SEQ ID NO: 1525 - DNA, 60 bp, Artificial Sequence
  Synthetic oligonucleotide probe
ttagtgacatatctgggtcctacgtcgtccctggcactgccctccaaccgctttaccaag

SEQ ID NO: 1526 - DNA, 60 bp, Artificial Sequence
  Synthetic oligonucleotide probe
atgtcgaccccgctgaatccgctattagtgacatatctgggtcctacgtcgtccctggca

SEQ ID NO: 1527 - DNA, 60 bp, Artificial Sequence
  Synthetic oligonucleotide probe
cgaggcctatgaggggtctgatgtcgaccccgctgaatccgctattagtgacatatctgg

SEQ ID NO: 1528 - DNA, 60 bp, Artificial Sequence
  Synthetic oligonucleotide probe
ttttatgaagtggctgggccaggagtgcacctgtttcctacaacctgcagaaggcgccgt

SEQ ID NO: 1529 - DNA, 60 bp, Artificial Sequence
  Synthetic oligonucleotide probe
gcggtctcaaagttttgctgttttatgaagtggctgggccaggagtgcacctgtttccta

SEQ ID NO: 1530 - DNA, 60 bp, Artificial Sequence
  Synthetic oligonucleotide probe
gtaggactgcgattcgtaaggcggtctcaaagttttgctgttttatgaagtggctgggcc

SEQ ID NO: 1531 - DNA, 60 bp, Artificial Sequence
  Synthetic oligonucleotide probe
gagctcatgccattgttgccttgacgcgccacactgagaagtgcgtcatcattgacgcac

SEQ ID NO: 1532 - DNA, 60 bp, Artificial Sequence
  Synthetic oligonucleotide probe
cgagctcatgccattgttgccttgacgcgccacactgagaagtgcgtcatcattgacgca

SEQ ID NO: 1533 - DNA, 60 bp, Artificial Sequence
  Synthetic oligonucleotide probe
tcccgagctcatgccattgttgccttgacgcgccacactgagaagtgcgtcatcattgac

SEQ ID NO: 1534 - DNA, 60 bp, Artificial Sequence
  Synthetic oligonucleotide probe
gtcccgagctcatgccattgttgccttgacgcgccacactgagaagtgcgtcatcattga

SEQ ID NO: 1535 - DNA, 60 bp, Artificial Sequence
  Synthetic oligonucleotide probe
tcgtcccgagctcatgccattgttgccttgacgcgccacactgagaagtgcgtcatcatt

SEQ ID NO: 1536 - DNA, 60 bp, Artificial Sequence
  Synthetic oligonucleotide probe
ttattgccacggcagatgctcgaggcctcattcagtcgtcccgagctcatgccattgttg

SEQ ID NO: 1537 - DNA, 60 bp, Artificial Sequence
  Synthetic oligonucleotide probe
attattgccacggcagatgctcgaggcctcattcagtcgtcccgagctcatgccattgtt

SEQ ID NO: 1538 - DNA, 60 bp, Artificial Sequence
  Synthetic oligonucleotide probe
cattattgccacggcagatgctcgaggcctcattcagtcgtcccgagctcatgccattgt

SEQ ID NO: 1539 - DNA, 60 bp, Artificial Sequence
  Synthetic oligonucleotide probe
accattattgccacggcagatgctcgaggcctcattcagtcgtcccgagctcatgccatt

SEQ ID NO: 1540 - DNA, 60 bp, Artificial Sequence
  Synthetic oligonucleotide probe
taccattattgccacggcagatgctcgaggcctcattcagtcgtcccgagctcatgccat

SEQ ID NO: 1541 - DNA, 60 bp, Artificial Sequence; identical to SEQ ID NO: 1502
  Synthetic oligonucleotide probe

SEQ ID NO: 1542 - DNA, 60 bp, Artificial Sequence
  Synthetic oligonucleotide probe
ttctatggaatacagtctggaacatggccgttatcacccactgttatgatttccgcgatc

SEQ ID NO: 1543 - DNA, 60 bp, Artificial Sequence
  Synthetic oligonucleotide probe
cttctatggaatacagtctggaacatggccgttatcacccactgttatgatttccgcgat

SEQ ID NO: 1544 - DNA, 60 bp, Artificial Sequence; identical to SEQ ID NO: 1503
  Synthetic oligonucleotide probe

SEQ ID NO: 1545 - DNA, 60 bp, Artificial Sequence
  Synthetic oligonucleotide probe
attccacccagaataatttttccttgggcctagagtgtgctattatggtggagtgtggga

SEQ ID NO: 1546 - DNA, 60 bp, Artificial Sequence
  Synthetic oligonucleotide probe
tgattccacccagaataatttttccttgggcctagagtgtgctattatggtggagtgtgg

SEQ ID NO: 1547 - DNA, 60 bp, Artificial Sequence
  Synthetic oligonucleotide probe
ttgattccacccagaataatttttccttgggcctagagtgtgctattatggtggagtgtg

SEQ ID NO: 1548 - DNA, 60 bp, Artificial Sequence
  Synthetic oligonucleotide probe
tttgattccacccagaataatttttccttgggcctagagtgtgctattatggtggagtgt

SEQ ID NO: 1549 - DNA, 60 bp, Artificial Sequence
  Synthetic oligonucleotide probe
gtttgattccacccagaataatttttccttgggcctagagtgtgctattatggtggagtg

SEQ ID NO: 1550 - DNA, 60 bp, Artificial Sequence
  Synthetic oligonucleotide probe
agtttgattccacccagaataatttttccttgggcctagagtgtgctattatggtggagt

SEQ ID NO: 1551 - DNA, 60 bp, Artificial Sequence
  Synthetic oligonucleotide probe
ttctggggtgaccgggctgattctcagcccttcgcaatcccctatattcatccaaccaac

SEQ ID NO: 1552 - DNA, 60 bp, Artificial Sequence
  Synthetic oligonucleotide probe
tttctggggtgaccgggctgattctcagcccttcgcaatcccctatattcatccaaccaa

SEQ ID NO: 1553 - DNA, 60 bp, Artificial Sequence
  Synthetic oligonucleotide probe
gtttctggggtgaccgggctgattctcagcccttcgcaatcccctatattcatccaacca

SEQ ID NO: 1554 - DNA, 60 bp, Artificial Sequence
  Synthetic oligonucleotide probe
ggtttctggggtgaccgggctgattctcagcccttcgcaatcccctatattcatccaacc

SEQ ID NO: 1555 - DNA, 60 bp, Artificial Sequence
  Synthetic oligonucleotide probe
tggtttctggggtgaccgggctgattctcagcccttcgcaatcccctatattcatccaac

SEQ ID NO: 1556 - DNA, 60 bp, Artificial Sequence
  Synthetic oligonucleotide probe
gtggtttctggggtgaccgggctgattctcagcccttcgcaatcccctatattcatccaa

SEQ ID NO: 1557 - DNA, 60 bp, Artificial Sequence
  Synthetic oligonucleotide probe
ggtggtttctggggtgaccgggctgattctcagcccttcgcaatcccctatattcatcca

SEQ ID NO: 1558 - DNA, 60 bp, Artificial Sequence
  Synthetic oligonucleotide probe
gtgaccgggctgattctcagcccttcgcaatcccctatattcatccaaccaaccccttcg

SEQ ID NO: 1559 - DNA, 60 bp, Artificial Sequence
  Synthetic oligonucleotide probe
ggtgaccgggctgattctcagcccttcgcaatcccctatattcatccaaccaaccccttc

SEQ ID NO: 1560 - DNA, 60 bp, Artificial Sequence
  Synthetic oligonucleotide probe
gggtgaccgggctgattctcagcccttcgcaatcccctatattcatccaaccaacccctt

SEQ ID NO: 1561 - DNA, 60 bp, Artificial Sequence
  Synthetic oligonucleotide probe
aagccgggtacccttataattataacaccactgctagtgaccaactgctcgttgagaatg

SEQ ID NO: 1562 - DNA, 60 bp, Artificial Sequence
  Synthetic oligonucleotide probe
aaagccgggtacccttataattataacaccactgctagtgaccaactgctcgttgagaat

SEQ ID NO: 1563 - DNA, 60 bp, Artificial Sequence
  Synthetic oligonucleotide probe
taaagccgggtacccttataattataacaccactgctagtgaccaactgctcgttgagaa

SEQ ID NO: 1564 - DNA, 60 bp, Artificial Sequence
  Synthetic oligonucleotide probe
ctaaagccgggtacccttataattataacaccactgctagtgaccaactgctcgttgaga

SEQ ID NO: 1565 - DNA, 60 bp, Artificial Sequence
  Synthetic oligonucleotide probe
actaaagccgggtacccttataattataacaccactgctagtgaccaactgctcgttgag

SEQ ID NO: 1566 - DNA, 60 bp, Artificial Sequence
  Synthetic oligonucleotide probe
tactaaagccgggtacccttataattataacaccactgctagtgaccaactgctcgttga

SEQ ID NO: 1567 - DNA, 60 bp, Artificial Sequence
  Synthetic oligonucleotide probe
ctactaaagccgggtacccttataattataacaccactgctagtgaccaactgctcgttg

SEQ ID NO: 1568 - DNA, 60 bp, Artificial Sequence
  Synthetic oligonucleotide probe
actactaaagccgggtacccttataattataacaccactgctagtgaccaactgctcgtt

SEQ ID NO: 1569 - DNA, 60 bp, Artificial Sequence
  Synthetic oligonucleotide probe
tactactaaagccgggtacccttataattataacaccactgctagtgaccaactgctcgt

SEQ ID NO: 1570 - DNA, 60 bp, Artificial Sequence
  Synthetic oligonucleotide probe
gtactactaaagccgggtacccttataattataacaccactgctagtgaccaactgctcg

SEQ ID NO: 1571 - DNA, 60 bp, Artificial Sequence
  Synthetic oligonucleotide probe
tatcagaacgaagcacagaacgctcggacttggcctagaacattgtttatcaatgctcca

SEQ ID NO: 1572 - DNA, 60 bp, Artificial Sequence
  Synthetic oligonucleotide probe
aatgcctcttgatcattttccaactaaatctgaaattcggcgttaccacaccgaaaccca

SEQ ID NO: 1573 - DNA, 60 bp, Artificial Sequence
  Synthetic oligonucleotide probe
ttattatcgtgacttaggctacaggcctaatcgtgctggtttgactctcacctttggaga

SEQ ID NO: 1574 - DNA, 60 bp, Artificial Sequence
  Synthetic oligonucleotide probe
tgtcaagaagtctgaagttcgcaactcccttaatggatgcgaagtactctcctaccgtaa

SEQ ID NO: 1575 - DNA, 60 bp, Artificial Sequence
  Synthetic oligonucleotide probe
cacaaactttatggatcacatcgtcagactagccgatacatatttcaattcaattgtcaa

SEQ ID NO: 1576 - DNA, 60 bp, Artificial Sequence
  Synthetic oligonucleotide probe
taaagtgcaaggtgacgattctatacttcgtttaactactctgattcctgttgaccaaca

SEQ ID NO: 1577 - DNA, 60 bp, Artificial Sequence
  Synthetic oligonucleotide probe
ttatactatgctcgccaccattctgagcgcgcttcatttcgatcccttacactgtattat

SEQ ID NO: 1578 - DNA, 60 bp, Artificial Sequence
  Synthetic oligonucleotide probe
acactttgctggaataccttccggcttgtttattacccaactcttagactcctggtataa

SEQ ID NO: 1579 - DNA, 60 bp, Artificial Sequence
  Synthetic oligonucleotide probe
agacttgaacgtctctggctgtggactctcgaaaacctttttgaggctccaatcatctta

SEQ ID NO: 1580 - DNA, 60 bp, Artificial Sequence
  Synthetic oligonucleotide probe
tgtaaagactttccttacttttgaagaaggatacgtccctactcacgcagctcccactca

SEQ ID NO: 1581 - DNA, 60 bp, Artificial Sequence
  Synthetic oligonucleotide probe
ttgttactcagagttgtcagacagttcttggctctctttttgggaagtctgccaaagggt

SEQ ID NO: 1582 - DNA, 60 bp, Artificial Sequence
  Synthetic oligonucleotide probe
cgacctacttgttgagtaaagccgtggaaaagtcttctgcttttacaatgcttctggggt

SEQ ID NO: 1583 - DNA, 60 bp, Artificial Sequence
  Synthetic oligonucleotide probe
aatttcttgtgactatgtcggtcattagtggtccttgcggacgtcctactctcttcctta

SEQ ID NO: 1584 - DNA, 60 bp, Artificial Sequence
  Synthetic oligonucleotide probe
agtgcctttacatgggcttgggcttagttgcatctacatgcattgtggctttgattgaaa

SEQ ID NO: 1585 - DNA, 60 bp, Artificial Sequence
  Synthetic oligonucleotide probe
tttgaagcactgggcaggagctgcgcacgaaaagttgcacaattttttggaaggaattga

SEQ ID NO: 1586 - DNA, 60 bp, Artificial Sequence
  Synthetic oligonucleotide probe
tttttcttcatggctcccttgcatcagaggggcttttgcatggtttggcaacatcataga

SEQ ID NO: 1587 - DNA, 60 bp, Artificial Sequence
  Synthetic oligonucleotide probe
tatctactctaacaacccgttctatccaaggtttcttggagtgcttacgggacgcgattt

SEQ ID NO: 1588 - DNA, 60 bp, Artificial Sequence
  Synthetic oligonucleotide probe
aaattggacagtctctcttaacttgtgctcagagtgttaccaaggccatatatgccaagt

SEQ ID NO: 1589 - DNA, 60 bp, Artificial Sequence
  Synthetic oligonucleotide probe
ttttaatttggcatcatatagtgcaagctacaatagcttggtgcctgaagagggcggcag

SEQ ID NO: 1590 - DNA, 60 bp, Artificial Sequence
  Synthetic oligonucleotide probe
tgttgtctacaatgctgatgcctctggtcagatgattcgctacaacaccactacttgtga

SEQ ID NO: 1591 - DNA, 60 bp, Artificial Sequence
  Synthetic oligonucleotide probe
tttggtctatctccggaaatgcttcttttgtggctggagcggcttcgattttcactatag

SEQ ID NO: 1592 - DNA, 60 bp, Artificial Sequence
  Synthetic oligonucleotide probe
attgaaattggcccttggttcattcttggctattctggctgggagtgcaatcttttgctc

SEQ ID NO: 1593 - DNA, 60 bp, Artificial Sequence
  Synthetic oligonucleotide probe
actgccttgaggtcactaagagcaattcgcgaagttcctacatatgggagtacaagagtt

SEQ ID NO: 1594 - DNA, 60 bp, Artificial Sequence
  Synthetic oligonucleotide probe
cctacttgcatgttttgagtggacacatagccagtaatgagacgagaggttggtttttga

SEQ ID NO: 1595 - DNA, 60 bp, Artificial Sequence
  Synthetic oligonucleotide probe
gaaaaagtgtgaagattcttatatgcgtgagcagatagagtccttacccaagtggcagcg

SEQ ID NO: 1596 - DNA, 60 bp, Artificial Sequence
  Synthetic oligonucleotide probe
agtgctctatgcaaagaatattgtaataaggggttgggttgatgcgaatttgcaagcatc

SEQ ID NO: 1597 - DNA, 60 bp, Artificial Sequence
  Synthetic oligonucleotide probe
tgaaaagtgctttgatgtgccaggacatggccaaaaactttccaaccttgaatcccttgg

SEQ ID NO: 1598 - DNA, 60 bp, Artificial Sequence
  Synthetic oligonucleotide probe
ttcccatgcatttgatgaaacttgataagatggacaaagccactatggcaagcactagtc

SEQ ID NO: 1599 - DNA, 60 bp, Artificial Sequence
  Synthetic oligonucleotide probe
aatttgtgttatgaccacttcctatgctccgaaggcggtcattcagtacggaatagatca

SEQ ID NO: 1600 - DNA, 60 bp, Artificial Sequence
  Synthetic oligonucleotide probe
tttgtcatctttgcctatcccagagagaagcgaaaaggaagctttgcaagctctcatagg

SEQ ID NO: 1601 - DNA, 60 bp, Artificial Sequence
  Synthetic oligonucleotide probe
ttgcaattattgaagggaagtgtaaattggtaggattgcatgtggcttcggacggagaag

SEQ ID NO: 1602 - DNA, 60 bp, Artificial Sequence
  Synthetic oligonucleotide probe
acatacaggaatcctactgtagccggagattgtggtggattggtgcttgcaattattgaa

SEQ ID NO: 1603 - DNA, 60 bp, Artificial Sequence
  Synthetic oligonucleotide probe
tgtttctggggagtacagaagagtgatttcacaccatttgacatacaggaatcctactgt

SEQ ID NO: 1604 - DNA, 60 bp, Artificial Sequence
  Synthetic oligonucleotide probe
tcttcacgtacaaatttgacaaagacatgcagcagtatgttcctgaacttggagagcttt

SEQ ID NO: 1605 - DNA, 60 bp, Artificial Sequence
  Synthetic oligonucleotide probe
tttgatctggaaactttgcctaaaacttttccagcgcagttcttcacgtacaaatttgac

SEQ ID NO: 1606 - DNA, 60 bp, Artificial Sequence
  Synthetic oligonucleotide probe
ccaatttgcccaaagccccagatagtttggtggataggttccactttgatctggaaactt

SEQ ID NO: 1607 - DNA, 60 bp, Artificial Sequence
  Synthetic oligonucleotide probe
aaattgtttgagaattctgagatagctctctacacttcgtccaatttgcccaaagcccca

SEQ ID NO: 1608 - DNA, 60 bp, Artificial Sequence
  Synthetic oligonucleotide probe
aatgactgagacatactttgtgtgggagaaatccaagttgaaattgtttgagaattctga

SEQ ID NO: 1609 - DNA, 60 bp, Artificial Sequence
  Synthetic oligonucleotide probe
gaatgattccaaatggtgtcatggtgaaactggagacgggaatgactgagacatactttg

SEQ ID NO: 1610 - DNA, 60 bp, Artificial Sequence
  Synthetic oligonucleotide probe
gcaccaggaaggagttttttaggagtcaatcactttttgagaatgattccaaatggtgtc

SEQ ID NO: 1611 - DNA, 60 bp, Artificial Sequence
  Synthetic oligonucleotide probe
agtgccctgggaatttgtaagaaattaagttatttgccaaaggacttcccggatcttttt

SEQ ID NO: 1612 - DNA, 60 bp, Artificial Sequence
  Synthetic oligonucleotide probe
ataatgctttatcgttcagttgataggttgcctagggctttgagcaataaggcacttact

SEQ ID NO: 1613 - DNA, 60 bp, Artificial Sequence
  Synthetic oligonucleotide probe
aaaggtaacaaaatgttgttcatttctcaaagctctgtgataccagcttatgtctttgct

SEQ ID NO: 1614 - DNA, 60 bp, Artificial Sequence
  Synthetic oligonucleotide probe
gagcaaaatgtcatcaggaaaggttgtgccattcaaaaagccttcaagcaaggtttagag

SEQ ID NO: 1615 - DNA, 60 bp, Artificial Sequence
  Synthetic oligonucleotide probe
tttcagataatttttccctacggggcaggaagaggaggattgccatctaaagctttcatg

SEQ ID NO: 1616 - DNA, 60 bp, Artificial Sequence
  Synthetic oligonucleotide probe
tttgatgattacttcaccatttccataaccacaaacaggaagtttgaggatggaaaagga

SEQ ID NO: 1617 - DNA, 60 bp, Artificial Sequence
  Synthetic oligonucleotide probe
aagacacaggaaataatgcctggtttgttcgtggcatcagaaaagaacttcactgggaat

SEQ ID NO: 1618 - DNA, 60 bp, Artificial Sequence
  Synthetic oligonucleotide probe
atgaatggtgaacatccctttgtggaggcctgtcaccaacttgagaatctggaacttatg

SEQ ID NO: 1619 - DNA, 60 bp, Artificial Sequence
  Synthetic oligonucleotide probe
aaatgggtagaaccccagaggttactgacaatcagccaagtggcattgtttcacaatgag

SEQ ID NO: 1620 - DNA, 60 bp, Artificial Sequence
  Synthetic oligonucleotide probe
gatggcagaggagcatttgtggccacaattgcattttgttaaagcgaagaaggtggaaat

SEQ ID NO: 1621 - DNA, 60 bp, Artificial Sequence
  Synthetic oligonucleotide probe
gcgacaaaggcatcaacacaatgaagagttgatgtcattaaacatttatgcgtatttgat

SEQ ID NO: 1622 - DNA, 60 bp, Artificial Sequence
  Synthetic oligonucleotide probe
aatatggcaggtaagatattggatcaaatgcttatggatgagatgtctggagcatcgtgg

SEQ ID NO: 1623 - DNA, 60 bp, Artificial Sequence
  Synthetic oligonucleotide probe
tatggaaatatttgccatcaaaaatctcgacgcaaccatcaaggctcggttagaccccgt

SEQ ID NO: 1624 - DNA, 60 bp, Artificial Sequence
  Synthetic oligonucleotide probe
tacaatctacagagtgcaagactctcgtatacgttgctgcgtctgtcagtaagaaggtct

SEQ ID NO: 1625 - DNA, 60 bp, Artificial Sequence
  Synthetic oligonucleotide probe
ctaaaagaaccacttactttagatatgctaggaattgggatccaaaatattttggggcac

SEQ ID NO: 1626 - DNA, 60 bp, Artificial Sequence
  Synthetic oligonucleotide probe
gagcaggtgtacgggaggctctggagttgataagagattatgagataaccaaagatcatc

SEQ ID NO: 1627 - DNA, 60 bp, Artificial Sequence
  Synthetic oligonucleotide probe
agagatacacgagcacacgggtatgaagtttagtgatttgctagtggagatggattgtcc

SEQ ID NO: 1628 - DNA, 60 bp, Artificial Sequence
  Synthetic oligonucleotide probe
gaattaccttgcctgccaacaatttgcctaccctggtatgcatgcatacactctcttgat

SEQ ID NO: 1629 - DNA, 60 bp, Artificial Sequence
  Synthetic oligonucleotide probe
tatccacatggactttatgggttgcagtgaatgagaacagaacccctggattgctagtga

SEQ ID NO: 1630 - DNA, 60 bp, Artificial Sequence
  Synthetic oligonucleotide probe
tgtccgaaagctgtgttagatgctttccagcctactgaagcagccttagtatcattgaga

SEQ ID NO: 1631 - DNA, 60 bp, Artificial Sequence
  Synthetic oligonucleotide probe
gaaggtctataataatggataagggacaatatcttatgtctctaagtgtgtgtccaattg

SEQ ID NO: 1632 - DNA, 60 bp, Artificial Sequence
  Synthetic oligonucleotide probe
gatcattgagaaccacattgcattgatggcattggaggagtattccagttaatcaatgag

SEQ ID NO: 1633 - DNA, 60 bp, Artificial Sequence
  Synthetic oligonucleotide probe
tattctggctatggctgcagatggtttgactcctgaactgaaagaaaagattcagaatga

SEQ ID NO: 1634 - DNA, 60 bp, Artificial Sequence
  Synthetic oligonucleotide probe
taaaacagtctcaaccgccactccagaagagagaatcaggcatgaaaaggaaaagctcct

SEQ ID NO: 1635 - DNA, 60 bp, Artificial Sequence
  Synthetic oligonucleotide probe
actattggagcgtctcaaggcaggagaaagtcaacagttgttcctcccatagagatcaat

SEQ ID NO: 1636 - DNA, 60 bp, Artificial Sequence
  Synthetic oligonucleotide probe
aaagagctagtcaagactagagattcagttctatcagcgatgggaggtatcctctctgct

SEQ ID NO: 1637 - DNA, 60 bp, Artificial Sequence
  Synthetic oligonucleotide probe
ctagtgggataaaagggacatcggaggagttggtttcaaagatgaaagccaataaaaatg

SEQ ID NO: 1638 - DNA, 60 bp, Artificial Sequence
  Synthetic oligonucleotide probe
agaagatggtgtccgcaatcaaagagttacaaatagaggtgcgtaacatccaggtagcat

SEQ ID NO: 1639 - DNA, 60 bp, Artificial Sequence
  Synthetic oligonucleotide probe
cttcatctctggattggtttgttgctggaatcacatttgcaaacaattctatgattatgg

SEQ ID NO: 1640 - DNA, 60 bp, Artificial Sequence
  Synthetic oligonucleotide probe
tggttactgatgtgatgcagaatacagctatagcattgcatcacaacctcggtctggatg

SEQ ID NO: 1641 - DNA, 60 bp, Artificial Sequence
  Synthetic oligonucleotide probe
ttgtgttgtgccctcacaataaacgttgtgtgtggagtgcatcaggatgatttaagaaaa

SEQ ID NO: 1642 - DNA, 60 bp, Artificial Sequence
  Synthetic oligonucleotide probe
gaaagagggatgattgcgtgatcacgttgccatcttccgttgatatcgtgttaaagttgc

SEQ ID NO: 1643 - DNA, 60 bp, Artificial Sequence
  Synthetic oligonucleotide probe
cgtatagagcatgggaaagtgatgaggctgctcaagaataaacagatccgagagaagata

SEQ ID NO: 1644 - DNA, 60 bp, Artificial Sequence
  Synthetic oligonucleotide probe
aaagagaaggacaatgagaaccagagtacctgatcccgaggagccgatcaaattgacaaa

SEQ ID NO: 1645 - DNA, 60 bp, Artificial Sequence
  Synthetic oligonucleotide probe
ttcagatgaagacatatactacaggtctaaaggttccttgttcagcaaaggaaggaccat

SEQ ID NO: 1646 - DNA, 60 bp, Artificial Sequence
  Synthetic oligonucleotide probe
ggctgaagatattgatcagctcagtctttcatacaatgatagtaagattatatcacttcc

SEQ ID NO: 1647 - DNA, 60 bp, Artificial Sequence
  Synthetic oligonucleotide probe
aactagggatccaaggggttgctattaatggcacagagagtgctgacattgatgagttag

SEQ ID NO: 1648 - DNA, 60 bp, Artificial Sequence
  Synthetic oligonucleotide probe
tgtttagcatttgcatagggtatatagtgagctcggtcaatacactgcatcccgttagtc

SEQ ID NO: 1649 - DNA, 60 bp, Artificial Sequence
  Synthetic oligonucleotide probe
acagaagagattgtctgtccttctcggtataaaaggaatagatgtagagccgggtgtcga

SEQ ID NO: 1650 - DNA, 60 bp, Artificial Sequence
  Synthetic oligonucleotide probe
aggacgggcagactatgtaagttacccaaatcattgtttatccctaacggacccgatgat

SEQ ID NO: 1651 - DNA, 60 bp, Artificial Sequence
  Synthetic oligonucleotide probe
ccttccgatgagaaaaatgttcttgcaagcaaataaggattgttttagagtttgatgctg

SEQ ID NO: 1652 - DNA, 60 bp, Artificial Sequence
  Synthetic oligonucleotide probe
ctgcatggatgacaacccttttggagtgttgacaaagaagccttccgatgagaaaaatgt

SEQ ID NO: 1653 - DNA, 60 bp, Artificial Sequence
  Synthetic oligonucleotide probe
tagatataggaatatcttctatcgaggccacaagtgtagcagtgctcaggagggttaaag

SEQ ID NO: 1654 - DNA, 60 bp, Artificial Sequence
  Synthetic oligonucleotide probe
acacttggttgtattgaaagagtgcaagtacatatcatcagggaaactagatataggaat

SEQ ID NO: 1655 - DNA, 60 bp, Artificial Sequence
  Synthetic oligonucleotide probe
acactttgaagatggggaggagctctctcatcttagaaccacacttggttgtattgaaag

SEQ ID NO: 1656 - DNA, 60 bp, Artificial Sequence
  Synthetic oligonucleotide probe
tgtgagttcttgtttccgtctgaagtgttcataccaacctctcacactttgaagatgggg

SEQ ID NO: 1657 - DNA, 60 bp, Artificial Sequence
  Synthetic oligonucleotide probe
agggtacataactaatataaccctgagagctgattctgacatacttggacctggggcact

SEQ ID NO: 1658 - DNA, 60 bp, Artificial Sequence
  Synthetic oligonucleotide probe
gttacttcattttctgagattctgaggaacatggaatccagagggtacataactaatata

SEQ ID NO: 1659 - DNA, 60 bp, Artificial Sequence
  Synthetic oligonucleotide probe
tgagctgttctcttcagggctgtctgaagttttcaaatcggttacttcattttctgagat

SEQ ID NO: 1660 - DNA, 60 bp, Artificial Sequence
  Synthetic oligonucleotide probe
aatcaatgtctgctaaactcaactggtacaggatcaccttcaacgacacagtgtggaggt

SEQ ID NO: 1661 - DNA, 60 bp, Artificial Sequence
  Synthetic oligonucleotide probe
ctcgcaaattaaagagactgttagggaatagagccaagtggcatgtgtgatttaagaaaa

SEQ ID NO: 1662 - DNA, 60 bp, Artificial Sequence
  Synthetic oligonucleotide probe
atgtatgcatcgctgttgtaggacacttaataggcatactgttgtacgtcttgaataagg

SEQ ID NO: 1663 - DNA, 60 bp, Artificial Sequence
  Synthetic oligonucleotide probe
gagccacacgacagtcaagcgacatggatctgaatgatcaattactagatccaatacact

SEQ ID NO: 1664 - DNA, 60 bp, Artificial Sequence
  Synthetic oligonucleotide probe
aaggtgtgggaaattatgagaaaagccaatcgtaaaagtcagtacaaacgcacaaacaca

SEQ ID NO: 1665 - DNA, 60 bp, Artificial Sequence
  Synthetic oligonucleotide probe
atgtctcacaaggtaacactctgggcaactgtattcttgactctaggtgctttggttgca

SEQ ID NO: 1666 - DNA, 60 bp, Artificial Sequence
  Synthetic oligonucleotide probe
aagataaacaggtcagccactgggatgcagagttttctaatcccttgacatggttgacga

SEQ ID NO: 1667 - DNA, 60 bp, Artificial Sequence
  Synthetic oligonucleotide probe
tatagtagatccaacagagttgagaaacagttggcaatcccacatagccaaggagggaag

SEQ ID NO: 1668 - DNA, 60 bp, Artificial Sequence
  Synthetic oligonucleotide probe
actagttttcgctgtagggaaccacgaatacgccatagatgatgacatgcatgtagagct

SEQ ID NO: 1669 - DNA, 60 bp, Artificial Sequence
  Synthetic oligonucleotide probe
aagtttggtattgggaccctctgaagagttatgtggatgagggaatgaactgtgaaagga

SEQ ID NO: 1670 - DNA, 60 bp, Artificial Sequence
  Synthetic oligonucleotide probe
tagttaagcctcattatttctgtgggaacccaaacagagttgctatcatttgtcacggga

SEQ ID NO: 1671 - DNA, 60 bp, Artificial Sequence
  Synthetic oligonucleotide probe
ggagtggaacgatcaacattgatccatgtttatgactatatacctatgttaaccttgata

SEQ ID NO: 1672 - DNA, 60 bp, Artificial Sequence
  Synthetic oligonucleotide probe
tattgggctatcgattggatcccgtcaggtcctcatatatggttgccttatctgttcaaa

SEQ ID NO: 1673 - DNA, 60 bp, Artificial Sequence
  Synthetic oligonucleotide probe
attatgagaaggttaggagtgtcctttttgggctagctgtgggaatgtgttcttcagcca

SEQ ID NO: 1674 - DNA, 60 bp, Artificial Sequence
  Synthetic oligonucleotide probe
aaagaaacctgaggacatatcgctgataacgtcggatgatgggaagcggctatatctatc

SEQ ID NO: 1675 - DNA, 60 bp, Artificial Sequence
  Synthetic oligonucleotide probe
ggggtctgttctgccatataaaggatcgtatacaagactgttaggataccttcaaagagg

SEQ ID NO: 1676 - DNA, 60 bp, Artificial Sequence
  Synthetic oligonucleotide probe
gacagcagacatgatagccatgacaataagactaaaagctttcttttctctgcctattgt

SEQ ID NO: 1677 - DNA, 60 bp, Artificial Sequence
  Synthetic oligonucleotide probe
aaatacagcggattgggcaatggaatctgtattctctgaaatcaacaggacaatagcatc

SEQ ID NO: 1678 - DNA, 60 bp, Artificial Sequence
  Synthetic oligonucleotide probe
ataacatgcaactcaagacagagagtgatgccagaggtttggtggatcatgaaagccaga

SEQ ID NO: 1679 - DNA, 60 bp, Artificial Sequence
  Synthetic oligonucleotide probe
atgagagagatggagaatcgactgagtatattgttgcccgtttttaagagtttagagctg

SEQ ID NO: 1680 - DNA, 60 bp, Artificial Sequence
  Synthetic oligonucleotide probe
cttaatggtgaaagcaggcaaactatgatagctacggtaacgatggcacatgattggaag

SEQ ID NO: 1681 - DNA, 60 bp, Artificial Sequence
  Synthetic oligonucleotide probe
tgtcatttgagctgaggagtgatactttggattggactttttgattttattatcgtccgt

SEQ ID NO: 1682 - DNA, 60 bp, Artificial Sequence
  Synthetic oligonucleotide probe
ctgtcatttgagctgaggagtgatactttggattggactttttgattttattatcgtccg

SEQ ID NO: 1683 - DNA, 60 bp, Artificial Sequence
  Synthetic oligonucleotide probe
tctgtcatttgagctgaggagtgatactttggattggactttttgattttattatcgtcc

SEQ ID NO: 1684 - DNA, 60 bp, Artificial Sequence
  Synthetic oligonucleotide probe
ctctgtcatttgagctgaggagtgatactttggattggactttttgattttattatcgtc

SEQ ID NO: 1685 - DNA, 60 bp, Artificial Sequence
  Synthetic oligonucleotide probe
actctgtcatttgagctgaggagtgatactttggattggactttttgattttattatcgt

SEQ ID NO: 1686 - DNA, 60 bp, Artificial Sequence
  Synthetic oligonucleotide probe
tactctgtcatttgagctgaggagtgatactttggattggactttttgattttattatcg

SEQ ID NO: 1687 - DNA, 60 bp, Artificial Sequence
  Synthetic oligonucleotide probe
gatacttatactctgtcatttgagctgaggagtgatactttggattggactttttgattt

SEQ ID NO: 1688 - DNA, 60 bp, Artificial Sequence
  Synthetic oligonucleotide probe
agatacttatactctgtcatttgagctgaggagtgatactttggattggactttttgatt

SEQ ID NO: 1689 - DNA, 60 bp, Artificial Sequence
  Synthetic oligonucleotide probe
aagatacttatactctgtcatttgagctgaggagtgatactttggattggactttttgat

SEQ ID NO: 1690 - DNA, 60 bp, Artificial Sequence
  Synthetic oligonucleotide probe
gaagatacttatactctgtcatttgagctgaggagtgatactttggattggactttttga

SEQ ID NO: 1691 - DNA, 60 bp, Artificial Sequence
  Synthetic oligonucleotide probe
aagaaaagtacatggactacctatccacccaagttcgctacttgggtgaagaagggtcta

SEQ ID NO: 1692 - DNA, 60 bp, Artificial Sequence
  Synthetic oligonucleotide probe
accacctgggctgagaacattaaaaatacagtcaacatggtgcgcaggatcataggtgat

SEQ ID NO: 1693 - DNA, 60 bp, Artificial Sequence
  Synthetic oligonucleotide probe
atggacagacattccctatttgggaaaaagggaagacttgtggtgtggatctctcatagg

SEQ ID NO: 1694 - DNA, 60 bp, Artificial Sequence
  Synthetic oligonucleotide probe
ttgcctagcaaaatcatatgcgcaaatgtggcagctcctttatttccacagaagggacct

SEQ ID NO: 1695 - DNA, 60 bp, Artificial Sequence
  Synthetic oligonucleotide probe
atatgggaaaagttaggaaggacacacaagagtggaaaccctcaactggatgggacaact

SEQ ID NO: 1696 - DNA, 60 bp, Artificial Sequence
  Synthetic oligonucleotide probe
atgattgcgttgtgaagccaattgatgataggtttgcacatgccctcaggttcttgaatg

SEQ ID NO: 1697 - DNA, 60 bp, Artificial Sequence
  Synthetic oligonucleotide probe
tagtggtgcaactcattcggaatatggaggctgaggaagttctagagatgcaagacttgt

SEQ ID NO: 1698 - DNA, 60 bp, Artificial Sequence
  Synthetic oligonucleotide probe
tttcgagacaagaccaaagggggagcggacaagttgtcacttacgctcttaacacattta

SEQ ID NO: 1699 - DNA, 60 bp, Artificial Sequence
  Synthetic oligonucleotide probe
caaaacaaagtggtaaaggtccttagaccagctgaaaaagggaaaacagttatggacatt

SEQ ID NO: 1700 - DNA, 60 bp, Artificial Sequence
  Synthetic oligonucleotide probe
tcagcaggtttgatctggagaatgaagctctaatcaccaaccaaatggagaaagggcaca

SEQ ID NO: 1701 - DNA, 60 bp, Artificial Sequence
  Synthetic oligonucleotide probe
tacttgggtgaagaagggtctacacctggagtgctgtaagcaccaatcttaatgttgtca

SEQ ID NO: 1702 - DNA, 60 bp, Artificial Sequence
  Synthetic oligonucleotide probe
atggtgcgcaggatcataggtgatgaagaaaagtacatggactacctatccacccaagtt

SEQ ID NO: 1703 - DNA, 60 bp, Artificial Sequence; identical to SEQ ID NO: 1693
  Synthetic oligonucleotide probe

SEQ ID NO: 1704 - DNA, 60 bp, Artificial Sequence; identical to SEQ ID NO: 1694
  Synthetic oligonucleotide probe

SEQ ID NO: 1705 - DNA, 60 bp, Artificial Sequence; identical to SEQ ID NO: 1695
  Synthetic oligonucleotide probe

SEQ ID NO: 1706 - DNA, 60 bp, Artificial Sequence; identical to SEQ ID NO: 1696
  Synthetic oligonucleotide probe

SEQ ID NO: 1707 - DNA, 60 bp, Artificial Sequence; identical to SEQ ID NO: 1697
  Synthetic oligonucleotide probe

SEQ ID NO: 1708 - DNA, 60 bp, Artificial Sequence; identical to SEQ ID NO: 1698
  Synthetic oligonucleotide probe

SEQ ID NO: 1709 - DNA, 60 bp, Artificial Sequence; identical to SEQ ID NO: 1699
  Synthetic oligonucleotide probe

SEQ ID NO: 1710 - DNA, 60 bp, Artificial Sequence
  Synthetic oligonucleotide probe
tagcaggtttgatctggagaatgaagctctaatcaccaaccaaatggagaaagggcacag

SEQ ID NO: 1711 - DNA, 60 bp, Artificial Sequence; identical to SEQ ID NO: 1701
  Synthetic oligonucleotide probe

SEQ ID NO: 1712 - DNA, 60 bp, Artificial Sequence; identical to SEQ ID NO: 1702
  Synthetic oligonucleotide probe

SEQ ID NO: 1713 - DNA, 60 bp, Artificial Sequence; identical to SEQ ID NO: 1693
  Synthetic oligonucleotide probe

SEQ ID NO: 1714 - DNA, 60 bp, Artificial Sequence; identical to SEQ ID NO: 1694
  Synthetic oligonucleotide probe

SEQ ID NO: 1715 - DNA, 60 bp, Artificial Sequence; identical to SEQ ID NO: 1695
  Synthetic oligonucleotide probe

SEQ ID NO: 1716 - DNA, 60 bp, Artificial Sequence; identical to SEQ ID NO: 1696
  Synthetic oligonucleotide probe

SEQ ID NO: 1717 - DNA, 60 bp, Artificial Sequence; identical to SEQ ID NO: 1697
  Synthetic oligonucleotide probe

SEQ ID NO: 1718 - DNA, 60 bp, Artificial Sequence; identical to SEQ ID NO: 1698
  Synthetic oligonucleotide probe

SEQ ID NO: 1719 - DNA, 60 bp, Artificial Sequence; identical to SEQ ID NO: 1699
  Synthetic oligonucleotide probe

SEQ ID NO: 1720 - DNA, 60 bp, Artificial Sequence; identical to SEQ ID NO: 1710
  Synthetic oligonucleotide probe

SEQ ID NO: 1721 - DNA, 60 bp, Artificial Sequence; identical to SEQ ID NO: 1691
  Synthetic oligonucleotide probe

SEQ ID NO: 1722 - DNA, 60 bp, Artificial Sequence
  Synthetic oligonucleotide probe
aatggacagacatcccctatttgggaaaaagggaagacttgtggtgtggatctctcatag

SEQ ID NO: 1723 - DNA, 60 bp, Artificial Sequence; identical to SEQ ID NO: 1694
  Synthetic oligonucleotide probe

SEQ ID NO: 1724 - DNA, 60 bp, Artificial Sequence; identical to SEQ ID NO: 1695
  Synthetic oligonucleotide probe

SEQ ID NO: 1725 - DNA, 60 bp, Artificial Sequence; identical to SEQ ID NO: 1696
  Synthetic oligonucleotide probe

SEQ ID NO: 1726 - DNA, 60 bp, Artificial Sequence; identical to SEQ ID NO: 1697
  Synthetic oligonucleotide probe

SEQ ID NO: 1727 - DNA, 60 bp, Artificial Sequence; identical to SEQ ID NO: 1698
  Synthetic oligonucleotide probe

SEQ ID NO: 1728 - DNA, 60 bp, Artificial Sequence; identical to SEQ ID NO: 1699
  Synthetic oligonucleotide probe

SEQ ID NO: 1729 - DNA, 60 bp, Artificial Sequence
  Synthetic oligonucleotide probe
taatcaccaaccaaatggaaaaagggcacagggccttggcattggccataatcaagtaca

SEQ ID NO: 1730 - DNA, 60 bp, Artificial Sequence
  Synthetic oligonucleotide probe
tatgtcctagaagagatgagtcgtataccaggaggaaggatgtatgcagatgacactgct

SEQ ID NO: 1731 - DNA, 60 bp, Artificial Sequence
  Synthetic oligonucleotide probe
cgaaagctagcaacagtatcaacaggttttatttggatttggaaacgagagtttctggtc

SEQ ID NO: 1732 - DNA, 60 bp, Artificial Sequence
  Synthetic oligonucleotide probe
agtttgaagcgaaagctagcaacagtatcaacaggttttatttggatttggaaacgagag

SEQ ID NO: 1733 - DNA, 60 bp, Artificial Sequence
  Synthetic oligonucleotide probe
atggaaataataaagaagttcaagaaagatctggctgccatgctgagaataatcaatgct

SEQ ID NO: 1734 - DNA, 60 bp, Artificial Sequence
  Synthetic oligonucleotide probe
ggggaaaaaagaggctatggaaataataaagaagttcaagaaagatctggctgccatgct

SEQ ID NO: 1735 - DNA, 60 bp, Artificial Sequence
  Synthetic oligonucleotide probe
atacagatcatggatcttggacacatgtgtgatgccaccatgagctatgaatgccctatg

SEQ ID NO: 1736 - DNA, 60 bp, Artificial Sequence
  Synthetic oligonucleotide probe
aagtgttatatacagatcatggatcttggacacatgtgtgatgccaccatgagctatgaa

SEQ ID NO: 1737 - DNA, 60 bp, Artificial Sequence
  Synthetic oligonucleotide probe
aagctcaacgagccaaaaagtcatatacttggtcatgatactgctgattgccccggcata

SEQ ID NO: 1738 - DNA, 60 bp, Artificial Sequence
  Synthetic oligonucleotide probe
gcttggcttttgggaagctcaacgagccaaaaagtcatatacttggtcatgatactgctg

SEQ ID NO: 1739 - DNA, 60 bp, Artificial Sequence
  Synthetic oligonucleotide probe
atggatctatttcccttatgtgcttggccttagggggagtgttgatcttcttatccacag

SEQ ID NO: 1740 - DNA, 60 bp, Artificial Sequence
  Synthetic oligonucleotide probe
tgggcaagggcatccatcaaatttttggagcagctttcaaatcattgtttggaggaatgt

SEQ ID NO: 1741 - DNA, 60 bp, Artificial Sequence
  Synthetic oligonucleotide probe
aggttgataaccgctaaccccgtaatcactgaaagcactgagaactctaagatgatgctg

SEQ ID NO: 1742 - DNA, 60 bp, Artificial Sequence
  Synthetic oligonucleotide probe
ctaggacttgattgtgaaccgaggacaggccttgacttttcagatttgtattacttgact

SEQ ID NO: 1743 - DNA, 60 bp, Artificial Sequence
  Synthetic oligonucleotide probe
actttttggcaaagggagtctggtgacatgcgctaagtttgcatgctccaagaaaatgac

SEQ ID NO: 1744 - DNA, 60 bp, Artificial Sequence
  Synthetic oligonucleotide probe
aagcaacttagtaaggtcaatggtgactgcaggatcaactgatcacatggatcacttctc

SEQ ID NO: 1745 - DNA, 60 bp, Artificial Sequence
  Synthetic oligonucleotide probe
gatcgagatgaaaacatgtgaatggccaaagtcccacacattgtggacagatggaataga

SEQ ID NO: 1746 - DNA, 60 bp, Artificial Sequence
  Synthetic oligonucleotide probe
gggtatttcacactagtgtctggctcaaggttagagaagattattcattagagtgtgatc

SEQ ID NO: 1747 - DNA, 60 bp, Artificial Sequence
  Synthetic oligonucleotide probe
tcaacgcaatcctggaagagaatggagttcaactgacggtcgttgtgggatctgtaaaaa

SEQ ID NO: 1748 - DNA, 60 bp, Artificial Sequence
  Synthetic oligonucleotide probe
tatgctcctctctctgaagggaaaaggcagtgtgaagaagaacttaccatttgtcatggc

SEQ ID NO: 1749 - DNA, 60 bp, Artificial Sequence
  Synthetic oligonucleotide probe
ggtttatgctcctctctctgaagggaaaaggcagtgtgaagaagaacttaccatttgtca

SEQ ID NO: 1750 - DNA, 60 bp, Artificial Sequence
  Synthetic oligonucleotide probe
gatagcggcattcaaagtcagaccagcgttgctggtatctttcatcttcagagctaattg

SEQ ID NO: 1751 - DNA, 60 bp, Artificial Sequence
  Synthetic oligonucleotide probe
acattgaaagagcaggtgacatcacatgggaaaaagatgcggaagtcactggaaacagtc

SEQ ID NO: 1752 - DNA, 60 bp, Artificial Sequence
  Synthetic oligonucleotide probe
catgtacattgaaagagcaggtgacatcacatgggaaaaagatgcggaagtcactggaaa

SEQ ID NO: 1753 - DNA, 60 bp, Artificial Sequence
  Synthetic oligonucleotide probe
gtggacatgtacattgaaagagcaggtgacatcacatgggaaaaagatgcggaagtcact

SEQ ID NO: 1754 - DNA, 60 bp, Artificial Sequence
  Synthetic oligonucleotide probe
acagatagaagatggtgctttgatggcacgaccaacaacaccataatggaagacagtgtg

SEQ ID NO: 1755 - DNA, 60 bp, Artificial Sequence
  Synthetic oligonucleotide probe
aagcaagaatgctccttgacaatatttacctccaagatggcctcatagcctcgctctatc

SEQ ID NO: 1756 - DNA, 60 bp, Artificial Sequence
  Synthetic oligonucleotide probe
attctggaaaaacagtttggtttgttccaagcgtgaggaacggcaatgagatcgcagctt

SEQ ID NO: 1757 - DNA, 60 bp, Artificial Sequence
  Synthetic oligonucleotide probe
atgacaacagcagtcaatgtcacccactctggaacagaaatcgtcgacttaatgtgccat

SEQ ID NO: 1758 - DNA, 60 bp, Artificial Sequence
  Synthetic oligonucleotide probe
tttttcgtcttgatgaggaacaagggcatagggaagatgggctttggaatggtgactctt

SEQ ID NO: 1759 - DNA, 60 bp, Artificial Sequence
  Synthetic oligonucleotide probe
tttggaatggtgactcttggggccagcgcatggctcatgtggctctcggaaattgagcca

SEQ ID NO: 1760 - DNA, 60 bp, Artificial Sequence
  Synthetic oligonucleotide probe
aagccattgacaacctcgctgtgctcatgcgggcagagactggaagcaggccttacaaag

SEQ ID NO: 1761 - DNA, 60 bp, Artificial Sequence
  Synthetic oligonucleotide probe
ctctacacatgagatgtactgggtctctggagcgaaaagcaacaccataaaaagtgtgtc

SEQ ID NO: 1762 - DNA, 60 bp, Artificial Sequence
  Synthetic oligonucleotide probe
agttacttggctggagcttctctaatctacacagtaacaagaaacgctggcttggtcaag

SEQ ID NO: 1763 - DNA, 60 bp, Artificial Sequence
  Synthetic oligonucleotide probe
gcatcatgaagaaccctgttgtggatggaatagtggtgactgacattgacacaatgacaa

SEQ ID NO: 1764 - DNA, 60 bp, Artificial Sequence
  Synthetic oligonucleotide probe
aatgaactcggatggttggagagaacaaagagtgacctaagccatctaatgggaaggaga

SEQ ID NO: 1765 - DNA, 60 bp, Artificial Sequence; identical to SEQ ID NO: 1691
  Synthetic oligonucleotide probe

SEQ ID NO: 1766 - DNA, 60 bp, Artificial Sequence; identical to SEQ ID NO: 1696
  Synthetic oligonucleotide probe

SEQ ID NO: 1767 - DNA, 60 bp, Artificial Sequence
  Synthetic oligonucleotide probe
tacaaagactcggatatgtcctagaagagatgagtcgcataccaggaggaaggatgtatg

SEQ ID NO: 1768 - DNA, 60 bp, Artificial Sequence
  Synthetic oligonucleotide probe
tggggcctgaactggagatcagctgtggatctccagaagagggactagtggttagaggag

SEQ ID NO: 1769 - DNA, 60 bp, Artificial Sequence
  Synthetic oligonucleotide probe
ccttcaatctggggcctgaactggagatcagctgtggatctccagaagagggactagtgg

SEQ ID NO: 1770 - DNA, 49 bp, Cytomegalovirus
gttgatgaactcaggtttggatatcgcacaagtcttcgacggctgttac

SEQ ID NO: 1771 - DNA, 45 bp, Cytomegalovirus
ctaccgcatgctcttccagatcggtcatacggactcggtgtcggc

SEQ ID NO: 1772 - DNA, 49 bp, Cytomegalovirus
cgtcccccataaccccgttgtgtatttaacgtcactggagaacaataaa

SEQ ID NO: 1773 - DNA, 45 bp, Cytomegalovirus
aaaccacgccggtggttacagaatcaccgttgtcggaggaaccct

SEQ ID NO: 1774 - DNA, 46 bp, Cytomegalovirus
gtagaaagcgttgcacgttactttgagcgccatctgttccttgtcg

SEQ ID NO: 1775 - DNA, 45 bp, Cytomegalovirus
gatctgctgtccgtcaaagatgacacgccgcaacggaattttagc

SEQ ID NO: 1776 - DNA, 49 bp, Cytomegalovirus
tagtgaaaattaatggtgttgaacagatcgcgcaccaatacggcgtcct

SEQ ID NO: 1777 - DNA, 47 bp, Cytomegalovirus
ctcgtagcacacgcacgagatctgaatgacaatgtcatcggacttct

SEQ ID NO: 1778 - DNA, 45 bp, Cytomegalovirus
accaggtcagagacatcgcagtcgacctcgatatcacaagtcgac

SEQ ID NO: 1779 - DNA, 45 bp, Cytomegalovirus
cagatactcgccgatttttctggccatggtccagttgctgataga

SEQ ID NO: 1780 - DNA, 45 bp, Cytomegalovirus
gtccgtctgatcgtaggtgtgaaaacgaataggtcccaccacgcg

SEQ ID NO: 1781 - DNA, 45 bp, Cytomegalovirus
gttttatgcttgatcaaccccgtctgaccgtcgaacatgacgcct

SEQ ID NO: 1782 - DNA, 49 bp, Cytomegalovirus
agaattataaacactttcctcgtaggaaggcggagcctgtaacgacgtg

SEQ ID NO: 1783 - DNA, 46 bp, Cytomegalovirus
acggtggagatactgctgaggtcaatcatgcgtttgaagaggtagt

SEQ ID NO: 1784 - DNA, 53 bp, Cytomegalovirus
gtagaccagattgtgcaccgattccatgttggataaatgagttgcattgttgc

SEQ ID NO: 1785 - DNA, 51 bp, Cytomegalovirus
gagatttttgcttgataccttgccagaacactaccaaaccaccagtggttt

SEQ ID NO: 1786 - DNA, 57 bp, Cytomegalovirus
acctcttgcttcttagataagaaagtggcggtcattttggcagaagaaaagtgatac

SEQ ID NO: 1787 - DNA, 48 bp, Cytomegalovirus
cattttggcagaagaaaagtgatacgagtcctcggcttcggaacgaat

SEQ ID NO: 1788 - DNA, 54 bp, Cytomegalovirus
cagaaagtgagttgacaagtgacattcttttcgtcctgtatatcccaggagatc

SEQ ID NO: 1789 - DNA, 52 bp, Cytomegalovirus
aaatgtcaaccacgtcacccgtggaagtggcgaaaaaatgataaggatattt

SEQ ID NO: 1790 - DNA, 60 bp, Cytomegalovirus
aaaaaatgataaggatatttggagcgcgcagtagtgatggtcaccatacaattcagatta

SEQ ID NO: 1791 - DNA, 53 bp, Cytomegalovirus
cagtagtgatggtcaccatacaattcagattacaggtctcacgatagagccag

SEQ ID NO: 1792 - DNA, 53 bp, Cytomegalovirus
gtaggaactgtagcactgactgtggctgttgatatgatgaatctcccacatag

SEQ ID NO: 1793 - DNA, 45 bp, Cytomegalovirus
cgtttgtagaccaccatgatgccctcgtccaggtcttcattgatg

SEQ ID NO: 1794 - DNA, 52 bp, Cytomegalovirus
gtatgagaggaatggtgactgtgagtagcagaagttccacgagtagaagatg

SEQ ID NO: 1795 - DNA, 58 bp, Cytomegalovirus
agatgcctgtagaggaggagatatagatctttggacttataaagacttccttcgtgac

SEQ ID NO: 1796 - DNA, 48 bp, Cytomegalovirus
ccactctttgttatacgtgagaatcacatctctgtccgggtgcagttc

SEQ ID NO: 1797 - DNA, 52 bp, Cytomegalovirus
atctccttctgcagcacgtttaggtcctgacagtccgaaaaattgaaaaaac

SEQ ID NO: 1798 - DNA, 49 bp, Cytomegalovirus
ctaggttgacatcgatgagtttgctagtcagacgctcctgcgttttgat

SEQ ID NO: 1799 - DNA, 58 bp, Cytomegalovirus
accagtaggtaaaatccgacaaggaatatattcgttccggtatatccgtaaacaggtt

SEQ ID NO: 1800 - DNA, 60 bp, Cytomegalovirus
tattcgttgcatttcgaacacactacgcatagtttctgtaacaaattcatctccatgact

SEQ ID NO: 1801 - DNA, 49 bp, Cytomegalovirus
ctcacgacggagtttatttacccaaagacgcttttttctcgctacttgg

SEQ ID NO: 1802 - DNA, 45 bp, Cytomegalovirus
cacgaaagcgtctaaaaagtcacgtcaatagcgacggtggaagtg

SEQ ID NO: 1803 - DNA, 49 bp, Cytomegalovirus
aaagacatggtagatctgaatcggcggatttttgtggctgcgctcaata

SEQ ID NO: 1804 - DNA, 47 bp, Cytomegalovirus
aaatgctcgtgtgaggtaaaagccacatccagcatgatgtgcgagat

SEQ ID NO: 1805 - DNA, 53 bp, Cytomegalovirus
atgatgtgcgagatcttgcccggtttgattatcatatttttgggacacaacac

SEQ ID NO: 1806 - DNA, 51 bp, Cytomegalovirus
tttgattatcatatttttgggacacaacaccgtaaagccgttgcgctcgtg

SEQ ID NO: 1807 - DNA, 45 bp, Cytomegalovirus
ctagtgtccgttttccatcaccagggtcctctgtttagagatcgc

SEQ ID NO: 1808 - DNA, 45 bp, Cytomegalovirus
gctcacgtcgatgaagacgaggtcgtggatctgatgaccgacgag

SEQ ID NO: 1809 - DNA, 45 bp, Cytomegalovirus
tttttccgcatgcgttcgaagtgacgtgatgcgtgacggagaaaa

SEQ ID NO: 1810 - DNA, 48 bp, Cytomegalovirus
caaagaggacgatttttgccacaagatctgttatgccgtggacatgag

SEQ ID NO: 1811 - DNA, 59 bp, Cytomegalovirus
ctatcaaatttctcaatcaccagtgtcgtgtatgccactttgatattacacccatgaac

SEQ ID NO: 1812 - DNA, 45 bp, Cytomegalovirus
ctttgatattacacccatgaacgtgctcatcgacgtgaacccgca

SEQ ID NO: 1813 - DNA, 45 bp, Cytomegalovirus
gagaagatgcgcaccatgacctgtttgggaaacttttgcatcagg

SEQ ID NO: 1814 - DNA, 50 bp, Cytomegalovirus
ccttgttgttcacctgcatggttttgcaaactttgatggcctcttctaac

SEQ ID NO: 1815 - DNA, 52 bp, Cytomegalovirus
tgttcttatctttcatgatattgcgcaccttctcgttgtccaactcggagat

SEQ ID NO: 1816 - DNA, 48 bp, Cytomegalovirus
ttcctcgctatcagagatcacgatacagccggcggtatcgataatctt

SEQ ID NO: 1817 - DNA, 60 bp, Cytomegalovirus
aggattacagagtataacatagagtataatatagagtatacaatagtgacgtgggatcca

SEQ ID NO: 1818 - DNA, 60 bp, Cytomegalovirus
gtgacgtgggatccataacagtaactgatatatatacaatagtttactggtcagccttgc

SEQ ID NO: 1819 - DNA, 60 bp, Cytomegalovirus
taactgatatatatacaatagtttactggtcagccttgcttctagtcaccatagggtggg

SEQ ID NO: 1820 - DNA, 54 bp, Cytomegalovirus
ctcatcactctgttcactttcttcctgatcactgttctcagccacaattactga

SEQ ID NO: 1821 - DNA, 46 bp, Cytomegalovirus
gtggccaaagtgtaggctacaatagcctcttcctcatctgactcct

SEQ ID NO: 1822 - DNA, 60 bp, Cytomegalovirus
ataaatatgtgatcaatgtgcgtgagcaccttgtctctctcctcatccaaaatcttaaag

SEQ ID NO: 1823 - DNA, 60 bp, Cytomegalovirus
ctctcctcatccaaaatcttaaagattttctgggcataagacataatctcatcaggagag

SEQ ID NO: 1824 - DNA, 54 bp, Cytomegalovirus
aagattttctgggcataagacataatctcatcaggagagcactgaggcaagttc

SEQ ID NO: 1825 - DNA, 60 bp, Cytomegalovirus
gtcttagggaaggctgagttcttggtaaagaactctatattcctgtagcacatatacatc

SEQ ID NO: 1826 - DNA, 60 bp, Cytomegalovirus
tggtaaagaactctatattcctgtagcacatatacatcatctttctcctaagttcatcct

SEQ ID NO: 1827 - DNA, 49 bp, Cytomegalovirus
atcatctttctcctaagttcatcctttttagcacgggccttagcctgca

SEQ ID NO: 1828 - DNA, 60 bp, Cytomegalovirus
ttcatgtcctcgaaaggctcatgaaccttatctaagatatctaaggcattctgcaaacat

SEQ ID NO: 1829 - DNA, 60 bp, Cytomegalovirus
tgaaccttatctaagatatctaaggcattctgcaaacatcctcccatcatattaaaggcg

SEQ ID NO: 1830 - DNA, 58 bp, Cytomegalovirus
atcctcccatcatattaaaggcgccagtgaatttttcttccgtctgggtatatttttt

SEQ ID NO: 1831 - DNA, 59 bp, Cytomegalovirus
cagtgaatttttcttccgtctgggtatattttttcagcatgtgctccttgattctatgc

SEQ ID NO: 1832 - DNA, 51 bp, Cytomegalovirus
ttgattctatgccgcaccatgtccactcgaaccttaatctgtttgactgta

SEQ ID NO: 1833 - DNA, 60 bp, Cytomegalovirus
catgtccactcgaaccttaatctgtttgactgtagaggaggataacaacacatataagta

SEQ ID NO: 1834 - DNA, 59 bp, Cytomegalovirus
aggaggataacaacacatataagtatccgtcctcctgactcatttatcgctatctcgat

SEQ ID NO: 1835 - DNA, 54 bp, Cytomegalovirus
atttatcgctatctcgatgccccgctcacatgcaagagttaatcttcactctat

SEQ ID NO: 1836 - DNA, 59 bp, Cytomegalovirus
tcacatgcaagagttaatcttcactctatctgacatacacaagtaaatccacgtcccat

SEQ ID NO: 1837 - DNA, 58 bp, Cytomegalovirus
tcccatgcaggttagtatatatcacatacatgtcaacagacttaccgagttctgtcag

SEQ ID NO: 1838 - DNA, 54 bp, Cytomegalovirus
tatcacatacatgtcaacagacttaccgagttctgtcaggacatctttttcggg

SEQ ID NO: 1839 - DNA, 46 bp, Cytomegalovirus
atctttttcggggttctcgttgcaatcctcggtcacttgttcaaag

SEQ ID NO: 1840 - DNA, 47 bp, Cytomegalovirus
gtcacttgttcaaaggttttgagggattcttcggccaattctgggaa

SEQ ID NO: 1841 - DNA, 45 bp, Cytomegalovirus
gattatcagggtccatctttctcttggcagaggactccatcgtgt

SEQ ID NO: 1842 - DNA, 45 bp, Cytomegalovirus
atctttctcttggcagaggactccatcgtgtcaaggacggtgact

SEQ ID NO: 1843 - DNA, 45 bp, Cytomegalovirus
cgttaacagcaccgcaacaggagttacctctgactctcaacagaa

SEQ ID NO: 1844 - DNA, 56 bp, Cytomegalovirus
gtctctgaaggacagagtattggcatatagccaataaagagagttgtggcaaagag

SEQ ID NO: 1845 - DNA, 55 bp, Cytomegalovirus
tgtccaagttgccatcctttctgaaatagatgacgttctcaggatcatgtttcat

SEQ ID NO: 1846 - DNA, 51 bp, Cytomegalovirus
gatgtagaagaggatagccagcactttcatgatctcgttattgcgcacgtt

SEQ ID NO: 1847 - DNA, 46 bp, Cytomegalovirus
tttcatgatctcgttattgcgcacgttgtgaacggaagactcgtgg

SEQ ID NO: 1848 - DNA, 49 bp, Cytomegalovirus
tatttctgttgctggtgctagtagggacttttgtgctgctggtcacatt

SEQ ID NO: 1849 - DNA, 47 bp, Cytomegalovirus
ttttgtgctgctggtcacattcgtaacgtcgctgaggtctatctgaa

SEQ ID NO: 1850 - DNA, 48 bp, Cytomegalovirus
catccaagcgatgagtttgtctaatgagtcctcggtggtgaaaaggat

SEQ ID NO: 1851 - DNA, 45 bp, Cytomegalovirus
cacgatcaccgaaagcgtcgtgagcacgctataaatggtgagcag

SEQ ID NO: 1852 - DNA, 45 bp, Cytomegalovirus
ataaagccggtgcaacagagaaagacggtgcctttaagatgcgga

SEQ ID NO: 1853 - DNA, 60 bp, Human herpesvirus 4
agaattcgtcttgctctattcacccttacttttcttcttgcccgttctctttcttagtat

SEQ ID NO: 1854 - DNA, 60 bp, Human herpesvirus 4
tacaaggcatttacggttagtgtgcctctgttatgaaatgcaggtttgacttcatatgta

SEQ ID NO: 1855 - DNA, 53 bp, Human herpesvirus 4
atgtctaacacgcttttgtctgcctggattcttacagcaggattcctgatttt

SEQ ID NO: 1856 - DNA, 45 bp, Human herpesvirus 4
aggcaacaactatgtgtatgcctacggaccagactggatggcaag

SEQ ID NO: 1857 - DNA, 45 bp, Human herpesvirus 4
ctccttccgtcagttccaggccatcaatcaccttgtcctgtttga

SEQ ID NO: 1858 - DNA, 45 bp, Human herpesvirus 4
cggcctctttcccttcgttaatgcaatagcatcatcgctgggctg

SEQ ID NO: 1859 - DNA, 45 bp, Human herpesvirus 4
tccctagttccaaaggggggtctgctgttgtttctgtctcaccta

SEQ ID NO: 1860 - DNA, 45 bp, Human herpesvirus 4
gctgaacgcagcatgtgccccaatcttggatccggaagacgtctt

SEQ ID NO: 1861 - DNA, 45 bp, Human herpesvirus 4
gtggaagttaatgtccagagatcacctctgattctggcccccaac

SEQ ID NO: 1862 - DNA, 60 bp, Human herpesvirus 4
acactacaataaacccaatgtgcaaatgtggtttgtatggctactttgtgttcctaaaaa

SEQ ID NO: 1863 - DNA, 55 bp, Human herpesvirus 4
attaacctcaaccacaaaatgggggttggagaaagtaaccacatatactggagat

SEQ ID NO: 1864 - DNA, 60 bp, Human herpesvirus 4
acaatacacccatctggagttcaacctaattacatggtagataaattaagagtccctcct

SEQ ID NO: 1865 - DNA, 59 bp, Human herpesvirus 4
aattccaaccatttttaaacctcctggaattctatcattaaacggcatgcaggaaaagg

SEQ ID NO: 1866 - DNA, 60 bp, Human herpesvirus 4
cactctactactgggtatcatatgctgactgtatatgcatgaggatagcatatgctaccc

SEQ ID NO: 1867 - DNA, 60 bp, Human herpesvirus 4
atgctacccagatatagattaggatagcctatgctacccagatataaattaggatagcat

SEQ ID NO: 1868 - DNA, 60 bp, Human herpesvirus 4
agcatatgctacccagatatagattaggatagcctatgctacccagatatagattaggat

SEQ ID NO: 1869 - DNA, 60 bp, Human herpesvirus 4
agcctatgctacccagatatagattaggatagcatatgctacccagatatagattaggat

SEQ ID NO: 1870 - DNA, 60 bp, Human herpesvirus 4
tccagatatttgggtagtatatgctacccagatataaattaggatagcatatactaccct

SEQ ID NO: 1871 - DNA, 60 bp, Human herpesvirus 4
acccagatataaattaggatagcatatactaccctaatctctattaggatagcatatgct

SEQ ID NO: 1872 - DNA, 60 bp, Human herpesvirus 4
atgctacccggatacagattaggatagcatatactacccagatatagattaggatagcat

SEQ ID NO: 1873 - DNA, 60 bp, Human herpesvirus 4
acccagatatagattaggatagcatatgctacccagatatagattaggatagcctatgct

SEQ ID NO: 1874 - DNA, 60 bp, Human herpesvirus 4
agcctatgctacccagatataaattaggatagcatatactacccagatatagattaggat

SEQ ID NO: 1875 - DNA, 60 bp, Human herpesvirus 4
agcatatactacccagatatagattaggatagcatatgctacccagatatagattaggat

SEQ ID NO: 1876 - DNA, 60 bp, Human herpesvirus 4
acccagatatagattaggatagcctatgctacccagatatagattaggatagcatatgct

SEQ ID NO: 1877 - DNA, 52 bp, Human herpesvirus 4
tatccagatatttgggtagtatatgctacccatggcaacattagcccaccgt

SEQ ID NO: 1878 - DNA, 56 bp, Human herpesvirus 4
gttagcggggttacaatcagccaagttattacacccttattttacagtccaaaacc

SEQ ID NO: 1879 - DNA, 60 bp, Human herpesvirus 4
tctattgttaaagatattcagaatgtttcattcctacactagtatttattgcccaagggg

SEQ ID NO: 1880 - DNA, 58 bp, Human herpesvirus 4
cattcctacactagtatttattgcccaaggggtttgtgagggttatattggtgtcata

SEQ ID NO: 1881 - DNA, 48 bp, Human herpesvirus 4
gtttgtgagggttatattggtgtcatagcacaatgccaccactgaacc

SEQ ID NO: 1882 - DNA, 58 bp, Human herpesvirus 4
ttaggacccttttactaaccctaattcgatagcatatgcttcccgttgggtaacatat

SEQ ID NO: 1883 - DNA, 60 bp, Human herpesvirus 4
tgggtaacatatgctattgaattagggttagtctggatagtatatactactacccgggaa

SEQ ID NO: 1884 - DNA, 57 bp, Human herpesvirus 4
aagcatatgctacccgtttagggttaacaagggggccttataaacactattgctaat

SEQ ID NO: 1885 - DNA, 50 bp, Human herpesvirus 4
tacacataaaggcaatgttgtgttgcagtccacagactgcaaagtctgct

SEQ ID NO: 1886 - DNA, 51 bp, Human herpesvirus 4
ctccaggatgaaagccactcagtgttggcaaatgtgcacatccatttataa

SEQ ID NO: 1887 - DNA, 53 bp, Human herpesvirus 4
aattttccccaaatgttgagggacctaagagatgccttcagtcgtgttaaaac

SEQ ID NO: 1888 - DNA, 54 bp, Human herpesvirus 4
agatgccttcagtcgtgttaaaacctttttccagacaaaggacgaggtagataa

SEQ ID NO: 1889 - DNA, 52 bp, Human herpesvirus 4
ctgaagccaaagaccatgtcaattctttgggtgaaaatctaaagaccctacg

SEQ ID NO: 1890 - DNA, 52 bp, Human herpesvirus 4
ccagagataatgtcacaagattatcaagttggtgtaaacacgccgtgggaaa

SEQ ID NO: 1891 - DNA, 53 bp, Human herpesvirus 4
tatctttggaacagtagaaaattgaaccttgttggcgggagaaggaataacgc

SEQ ID NO: 1892 - DNA, 59 bp, Human herpesvirus 4
ctacaaaaactctgtgttctgctgcaaattttagatcagatggcatagagacaaggaca

SEQ ID NO: 1893 - DNA, 60 bp, Human herpesvirus 4
tatttttgggaatggtgttaactttctccccttgtatttgctattcaatcaacctgattc

SEQ ID NO: 1894 - DNA, 55 bp, Human herpesvirus 4
gccaatctgtctacatagaagaagaagaggatgaagactaagtcacaggcttagc

SEQ ID NO: 1895 - DNA, 45 bp, Human herpesvirus 4
agcaaaagaggaacttgcccaggcagtcagttattttgcatgcca

SEQ ID NO: 1896 - DNA, 45 bp, Human herpesvirus 4
gtttaggatgtcaatgacgggcaaaaagcccacaggtagcccttg

SEQ ID NO: 1897 - DNA, 45 bp, Human herpesvirus 4
caaaaagcccacaggtagcccttgtgtaaatgactcttggaaggg

SEQ ID NO: 1898 - DNA, 48 bp, Human herpesvirus 4
gtcaacagactagccaagaaggactcgtgcacgtgcttctttacaaag

SEQ ID NO: 1899 - DNA, 55 bp, Human herpesvirus 4
ctcttctcccggcgttatcatggtagaataacagagattatgagcctgaatgatg

SEQ ID NO: 1900 - DNA, 45 bp, Human herpesvirus 4
gaccagaggacgcaggatatctgcaggatcaggtcagcctcgttg

SEQ ID NO: 1901 - DNA, 45 bp, Human herpesvirus 4
tggcatccacgttggcctcaaagatccgacacccgtgcttgtctt

SEQ ID NO: 1902 - DNA, 45 bp, Human herpesvirus 4
gatgccacatggcaccacatacccctgtttatccgatggaatgac

SEQ ID NO: 1903 - DNA, 53 bp, Human herpesvirus 4
cttaggaaagggttatagaagagtcccccagacatggttaaaactcagtctct

SEQ ID NO: 1904 - DNA, 50 bp, Human herpesvirus 4
aaaatgtattgacttccctgtttctgtggcgatggtcgagtcaaaggttt

SEQ ID NO: 1905 - DNA, 50 bp, Human herpesvirus 4
ggttgtcgtagtccactatcttgtagttagttctcacgtggaaggagtct

SEQ ID NO: 1906 - DNA, 51 bp, Human herpesvirus 4
gaaggtttccttatttttcccgtcatagaaaggggacatttccacagtctg

SEQ ID NO: 1907 - DNA, 57 bp, Human herpesvirus 4
atcatgtcagttatcaggcagttgacggtagttcttgttctgtaagtccatatcaac

SEQ ID NO: 1908 - DNA, 46 bp, Human herpesvirus 4
tcagcccatcttttgtcatcttgaccgcgttgtagcactggtagat

SEQ ID NO: 1909 - DNA, 54 bp, Human herpesvirus 4
gagcggaccttaaacgagtagggaataatgttgtctttaaacaccatcaacagg

SEQ ID NO: 1910 - DNA, 50 bp, Human herpesvirus 4
aataatgttgtctttaaacaccatcaacaggccctccgtgtgattctccc

SEQ ID NO: 1911 - DNA, 52 bp, Human herpesvirus 4
ctctcatttggaggtgcaggtagagaagggcatatagatccttaaataccca

SEQ ID NO: 1912 - DNA, 60 bp, Human herpesvirus 4
ccccatggtgtgagacatgcaataaaacacgctattgattctcttcattaaaatctctat

SEQ ID NO: 1913 - DNA, 60 bp, Human herpesvirus 4
cgctattgattctcttcattaaaatctctatgtcatttattaggcacaaacttacatcga

SEQ ID NO: 1914 - DNA, 52 bp, Human herpesvirus 4
acaccacatcaaacacacagtcttcctcctgtttttgtgatataatggcctc

SEQ ID NO: 1915 - DNA, 47 bp, Human herpesvirus 4
aatttcatgtagggcccgttgatgatgtagttctccctcctggtagt

SEQ ID NO: 1916 - DNA, 45 bp, Human herpesvirus 4
attctcccccgtgaagaccaccctgttcttgatcttgatgttcct

SEQ ID NO: 1917 - DNA, 45 bp, Human herpesvirus 4
ctaaagttggtgcacagcgtctggtagtgaccctttagccactct

SEQ ID NO: 1918 - DNA, 60 bp, Human herpesvirus 4
agaatttgtcttgctctattcaccgttacttttcttcttgcccgttctctttcttagtat

SEQ ID NO: 1919 - DNA, 59 bp, Human herpesvirus 4
acacttaacttgactacaatgttccttctcatgctcctatggacacttggtaagttttc

SEQ ID NO: 1920 - DNA, 60 bp, Human herpesvirus 4
cttcaagagtttaagcagcactgaatttatacccagtgagtatctatttgttactcctgt

SEQ ID NO: 1921 - DNA, 56 bp, Human herpesvirus 4
catgttattactgattgtcgctggcatactcttcattcttgctatcctgaccgaat

SEQ ID NO: 1922 - DNA, 60 bp, Human herpesvirus 4
ccccatatcgcaacactgtataaaggtaagtattattaaattttagagacactatcacgt

SEQ ID NO: 1923 - DNA, 60 bp, Human herpesvirus 4
ttacaaacactacaataaacccaatgtgcaaatgtggtttgtatggctactttgtgttcc

SEQ ID NO: 1924 - DNA, 60 bp, Human herpesvirus 4
gtttgtatggctactttgtgttcctaaaaaatgcaacaatagaagtggaaaccctcagtc

SEQ ID NO: 1925 - DNA, 60 bp, Human herpesvirus 4
gacaatacacccatctggagttcaacttaattacatggtagataaattaagagtccctcc

SEQ ID NO: 1926 - DNA, 52 bp, Human herpesvirus 4
gacgtagtctgtcttgaggagatgtagacttgtagacactgcaaaacctcag

SEQ ID NO: 1927 - DNA, 56 bp, Human herpesvirus 4
acgtggctgtttaccagcatatatagagttacggttcactacatcaaacaggacag

SEQ ID NO: 1928 - DNA, 56 bp, Human herpesvirus 4
caattccaaccatttttaaacctcctggaattctatcattaaacggcatgcaggaa

SEQ ID NO: 1929 - DNA, 60 bp, Human herpesvirus 4
tctactactgggtattatatgctgactgtatatgcattaggatagcatatgctacccaga

SEQ ID NO: 1930 - DNA, 60 bp, Human herpesvirus 4
acccagatatagattaggatagcatatgctacccggatatagattaggatagcatatact

SEQ ID NO: 1931 - DNA, 60 bp, Human herpesvirus 4
agcatatactacccaaatagagattaggatagcatatgctacccaaatagagattaggat

SEQ ID NO: 1932 - DNA, 60 bp, Human herpesvirus 4
acccggatatagattaggatagcatatactacccaaatagagattaggatagcatatgct

SEQ ID NO: 1933 - DNA, 60 bp, Human herpesvirus 4
atactacccaaatagagattaggatagcatatgctacccaaatagagattaggatagcat

SEQ ID NO: 1934 - DNA, 60 bp, Human herpesvirus 4
atgctacccaaatagagattaggatagcatatgctacccggatatagattaggatagcat

SEQ ID NO: 1935 - DNA, 60 bp, Human herpesvirus 4
gcatatgctacccaaatagagattgggatagcatatgctacccggatatagattaggata

SEQ ID NO: 1936 - DNA, 60 bp, Human herpesvirus 4
acccggatatagattaggatagcatatgctacccaaatagagattaggatagcatatgct

SEQ ID NO: 1937 - DNA, 60 bp, Human herpesvirus 4
acccaaatagagattaggatagcatatgctacccggatatagattaggatagcatatgct

SEQ ID NO: 1938 - DNA, 60 bp, Human herpesvirus 4
tacccggatatagattaggatagcatatgctacccaaatagagattgggatagcatatgc

SEQ ID NO: 1939 - DNA, 60 bp, Human herpesvirus 4
aatagagattgggatagcatatgctatcctaatctctatctgggtagcatatactatcct

SEQ ID NO: 1940 - DNA, 60 bp, Human herpesvirus 4
agcatatgctatcctaatctatatctgggtagcatatactatcctaatctctatatgggt

SEQ ID NO: 1941 - DNA, 60 bp, Human herpesvirus 4
agcatatactatcctaatctctatatgggtagcatatgctatcctaatctatatctgggt

SEQ ID NO: 1942 - DNA, 60 bp, Human herpesvirus 4
catatgctatcctaatctatatctgggtagcatatgctatccatcgcaacattagcccac

SEQ ID NO: 1943 - DNA, 55 bp, Human herpesvirus 4
cactctctttccccttgttacaaatagagtgtaacaacatggttcacctgtcttg

SEQ ID NO: 1944 - DNA, 60 bp, Human herpesvirus 4
cacatcttaataaccccagtatcatattgcactaggattatgtgttgcccatagccataa

SEQ ID NO: 1945 - DNA, 55 bp, Human herpesvirus 4
gattatgtgttgcccatagccataaattcgtgtgagatggacatccagtctttac

SEQ ID NO: 1946 - DNA, 60 bp, Human herpesvirus 4
tctattgttaaagatattcagaatgtttcattcctacactagtatttattgcccaaggag

SEQ ID NO: 1947 - DNA, 60 bp, Human herpesvirus 4
ctacactagtatttattgcccaaggagtttgtgagggttatattggtgtcatagcacaat

SEQ ID NO: 1948 - DNA, 57 bp, Human herpesvirus 4
ccttttactaaccctaattcgatagcatatgcttcccgttgggtaacatgtgctatt

SEQ ID NO: 1949 - DNA, 60 bp, Human herpesvirus 4
acatgtgctattgaattagggttagtctggatagtatatgctactacccgggaagcatat

SEQ ID NO: 1950 - DNA, 54 bp, Human herpesvirus 4
catatgctacccgtttagggttaaaaagggggccttataaacactcttgctaac

SEQ ID NO: 1951 - DNA, 56 bp, Human herpesvirus 4
agtcgtgttaaaacctttttccagacaaaggacgaggtagataaccttttgctcaa

SEQ ID NO: 1952 - DNA, 54 bp, Human herpesvirus 4
accctgaagccaaagaccatgtaaattctttgggtgaaaatctaaagaccctac

SEQ ID NO: 1953 - DNA, 56 bp, Human herpesvirus 4
atagaagcatacatgacaattaaagccaggtgataattccataccctggaagcagg

SEQ ID NO: 1954 - DNA, 60 bp, Human herpesvirus 4
ctacaaaaactctgtgttctgctgcaaattttagataagatggcatagagacaaggacac

SEQ ID NO: 1955 - DNA, 60 bp, Human herpesvirus 4
atgtcataagtgtaatgattagaaagtcataaacccacttccctttacatgaatctgggc

SEQ ID NO: 1956 - DNA, 60 bp, Human herpesvirus 4
gggtcacttccccttttataagtgtgtgaacagtgatttcagtaaaacctaagagatatt

SEQ ID NO: 1957 - DNA, 52 bp, Human herpesvirus 4
gcttcagatgccttctattgcactctcacaaaaacattctggacacatgtgc

SEQ ID NO: 1958 - DNA, 56 bp, Human herpesvirus 4
gacgccaatctgtctacatagaagaagaagaggatgaagactaagtcacaggctta

SEQ ID NO: 1959 - DNA, 60 bp, Human herpesvirus 4
ggatgaagactaagtcacaggcttagccaggtgatttgtgaatttcagtttatttacttt

SEQ ID NO: 1960 - DNA, 60 bp, Human herpesvirus 4
cctagtatccgttctattagattaactcgcaagatactaaaattaaccaaggtcagccca

SEQ ID NO: 1961 - DNA, 57 bp, Human herpesvirus 4
gttacatgggggacagtcatataatctaattgttgacactgatatgtctggaaaccc

SEQ ID NO: 1962 - DNA, 60 bp, Human herpesvirus 4
atccttaccaggaacaactatcaaataatccattaattcaactacaaatcgttgtcgggg

SEQ ID NO: 1963 - DNA, 53 bp, Human herpesvirus 4
agtgattggtatcctccaacgttagaacctgcagaattagatgaaagttggga

SEQ ID NO: 1964 - DNA, 60 bp, Human herpesvirus 4
aagaccttactctctccagtaatcaatgtatcccaaataaatgttaatgattttgttctt

SEQ ID NO: 1965 - DNA, 60 bp, Human herpesvirus 4
acacacaacacatagaattgttagtttaaacagtttattgatacatggctgcttttagcc

SEQ ID NO: 1966 - DNA, 60 bp, Human herpesvirus 4
ctccttccgttttaatggtagaataacctataggttattaacctagtggtggaatagggt

SEQ ID NO: 1967 - DNA, 53 bp, Human herpesvirus 4
cttcccttgttaacctgatagcatagcctctaggtttccttgtaggtctgttt

SEQ ID NO: 1968 - DNA, 60 bp, Human herpesvirus 4
ttaattacatttgtgccagatcttgtagagcaagatggcctattcaacaagggagatact

SEQ ID NO: 1969 - DNA, 60 bp, Human herpesvirus 4
tgtagttctgcgttatcatgtgttgcttgaggagataattgaacgaaattcagagacatt

SEQ ID NO: 1970 - DNA, 60 bp, Human herpesvirus 4
ggagataattgaacgaaattcagagacatttacagaaacttggaacagatttataacaca

SEQ ID NO: 1971 - DNA, 60 bp, Human herpesvirus 4
taacacacaccgaacatgtggacctggattttaactcagtatttttagagatatttcacc

SEQ ID NO: 1972 - DNA, 53 bp, Human herpesvirus 4
gacattgtgttgtaaccagtctactccttactatgttgtggacctgtcagttc

SEQ ID NO: 1973 - DNA, 60 bp, Human herpesvirus 4
gagttatactctacttatcttttttgacactacatttaactgttatgtaacaatgtttgc

SEQ ID NO: 1974 - DNA, 60 bp, Human herpesvirus 4
tgacactacatttaactgttatgtaacaatgtttgcttattttcatgttcaataaacgct

SEQ ID NO: 1975 - DNA, 60 bp, Human herpesvirus 4
caatgtttgcttattttcatgttcaataaacgctatgttaatgatgaagaacctgtgttc

SEQ ID NO: 1976 - DNA, 57 bp, Human herpesvirus 4
agcagagacacatagaaggtcttgttgggtattatcttgtggacattgttgaagaag

SEQ ID NO: 1977 - DNA, 60 bp, Human herpesvirus 4
cagcgtgaggtcttatttttgaaaagggatattataaaacaggtcattgctcggattgtg

SEQ ID NO: 1978 - DNA, 60 bp, Human herpesvirus 4
gggcacgaaacatggtgtatgcactttattaataaacaattacagatacaaaaacttgag

SEQ ID NO: 1979 - DNA, 55 bp, Human herpesvirus 4
acacagtagccgaatatctggaggtcttctctgacaaattctacgatgaggaatt

SEQ ID NO: 1980 - DNA, 60 bp, Human herpesvirus 4
ctacatgactagcatcaagcaaactaatttctttgagcaagagagttccgattacaccat

SEQ ID NO: 1981 - DNA, 47 bp, Human herpesvirus 4
tgcttgtgatcatggaaaccactcagactctccgctttaagaccaag

SEQ ID NO: 1982 - DNA, 49 bp, Human herpesvirus 4
gttaaggtgacactcaatccggatctctacgtcaccacgtatacttctg

SEQ ID NO: 1983 - DNA, 47 bp, Human herpesvirus 4
ccaagaaagtgaagcaggcctttaaccccctcatttaacaccatgtt

SEQ ID NO: 1984 - DNA, 60 bp, Human herpesvirus 4
cccttactactgccgttatattggtagaattacagttatcccactttatgtatggcactg

SEQ ID NO: 1985 - DNA, 60 bp, Human herpesvirus 4
gttatcccactttatgtatggcactgtttctggtattaggtatactgggttttgcatttc

SEQ ID NO: 1986 - DNA, 56 bp, Human herpesvirus 4
catggtgccaaacacatcttgaaagtagacatctacagattccaggcttacttgtt

SEQ ID NO: 1987 - DNA, 60 bp, Human herpesvirus 4
aaagtcaagattaagtttatgctttttgcccccgacatcgaaattgatagttgcattgac

SEQ ID NO: 1988 - DNA, 59 bp, Human herpesvirus 4
gtcgagaagccattctctacaggtttccgctagatttaagaaggtttattcaagcaatt

SEQ ID NO: 1989 - DNA, 60 bp, Human herpesvirus 4
cttgtgcagagttctaatccatgctacagtattttctttgactacatggccatacatagg

SEQ ID NO: 1990 - DNA, 55 bp, Human herpesvirus 4
atgaagtggtaacacctgatcagcgtgttacatttatggaattcctgggcttttt

SEQ ID NO: 1991 - DNA, 60 bp, Human herpesvirus 4
tgagagagacctcgcatatttgcagagggtcactgaaacattttatcttaaaacagttac

SEQ ID NO: 1992 - DNA, 53 bp, Human herpesvirus 4
gatccaactagtccatgctgtttatgattccatgttggtaagaggcacctaga

SEQ ID NO: 1993 - DNA, 56 bp, Human herpesvirus 4
ccggtctctaggcagtttattccttgagcaaaacctgaacatcgaagagtttatat

SEQ ID NO: 1994 - DNA, 60 bp, Human herpesvirus 4
gaggatgacgatgaaagtgaggaaattgaagataaatgtgataaggatgaagaggaaagt

SEQ ID NO: 1995 - DNA, 60 bp, Human herpesvirus 4
ttgaagataaatgtgataaggatgaagaggaaagtggaacggaagatgttacaagcatac

SEQ ID NO: 1996 - DNA, 60 bp, Human herpesvirus 4
aaagccagatactaaatcaaccaaaaaatgcagggccatagtgactgaccttagtataat

SEQ ID NO: 1997 - DNA, 60 bp, Human herpesvirus 4
gccatagtgactgaccttagtataatcaaggtcattgaagatgaacacagaaagaagaag

SEQ ID NO: 1998 - DNA, 55 bp, Human herpesvirus 4
ctatcaaacctgatactcgatagtggtttagacacacaacacctcttgtgcttcg

SEQ ID NO: 1999 - DNA, 60 bp, Human herpesvirus 4
aggcataaaagaacaagtaatccagaaagcatttctaaaggcacaaagacagggtttatc

SEQ ID NO: 2000 - DNA, 60 bp, Human herpesvirus 4
cccattccaggtgtgcttctttttggtgaaataaaaacagcgttctttatatgaaaatgt

SEQ ID NO: 2001 - DNA, 60 bp, Human herpesvirus 4
tggcagccttatttcacctcaatatgttctttattctcaaagattacataacacaagact

SEQ ID NO: 2002 - DNA, 60 bp, Human herpesvirus 4
tgcactccctgtattcactgagcgtcatctaataaagatgtctattgatctcttttagtg

SEQ ID NO: 2003 - DNA, 60 bp, Human herpesvirus 4
aatcaaatctttagagattacagacaccatgtttgacatctttcaaagtgctttcgggtt

SEQ ID NO: 2004 - DNA, 51 bp, Human herpesvirus 4
aactgccactagatgtccagataaggcttgtctcacagatgagtatcatgg

SEQ ID NO: 2005 - DNA, 50 bp, Human herpesvirus 4
cttgtgttcaacaccaatcgggtgatcaacactaaattggtgtgctcaga

SEQ ID NO: 2006 - DNA, 53 bp, Human herpesvirus 4
aagtctgttaaccaggtcagtggttttgtttccttgatagagacacaaggact

SEQ ID NO: 2007 - DNA, 57 bp, Human herpesvirus 4
ctatatctaaaggcctttcctcccaatacaaatgttactaacatctgccctctggag

SEQ ID NO: 2008 - DNA, 60 bp, Human herpesvirus 4
ctgcatgaaaaaccacatacacgtgatgtaagtttagccagtttattgttacaccaatgc

SEQ ID NO: 2009 - DNA, 55 bp, Human herpesvirus 4
ggttccatggcacatttacagataaacatagatgtcttgtcttgctcatgtgcag

SEQ ID NO: 2010 - DNA, 60 bp, Human herpesvirus 4
gtgcaatatagtttctggattccaaaatgagttgggggtgctattttcactatggaatta

SEQ ID NO: 2011 - DNA, 60 bp, Human herpesvirus 4
aaatgagttgggggtgctattttcactatggaattaaattactgacattagacagtggac

SEQ ID NO: 2012 - DNA, 60 bp, Human herpesvirus 4
gcaaattggccttattattaaattcttgttaacactaattctgttctatgaccctgtgtt

SEQ ID NO: 2013 - DNA, 60 bp, Human herpesvirus 4
tgatcctggaccttgactatgaaacaattcttaaaaaatgcatcatagtccagtgtccag

SEQ ID NO: 2014 - DNA, 45 bp, Human herpesvirus 4
aaagcgcagggtctcgctctctgaaaacccccggcactcgataaa

SEQ ID NO: 2015 - DNA, 45 bp, Human herpesvirus 4
gctcagggcctccacgaaggccttggcccgctccaacatcgtgcg

SEQ ID NO: 2016 - DNA, 46 bp, Human herpesvirus 4
aacagactagccaagaaggactcgtgcacgtgcttcttcacaaagt

SEQ ID NO: 2017 - DNA, 45 bp, Human herpesvirus 4
aaagtggtagacgccccccgtgagcctgaaggactcatagtcttc

SEQ ID NO: 2018 - DNA, 45 bp, Human herpesvirus 4
gtcttcgcaggtgcccagcgtcagcaggatgcgcctatagcgccc

SEQ ID NO: 2019 - DNA, 45 bp, Human herpesvirus 4
gaccagagaacgcaggatatctgcaggatcaggtcagcctcgttg

SEQ ID NO: 2020 - DNA, 45 bp, Human herpesvirus 4
gtcgaaggtgctggccttgagggcgctgaggactgcaaactccac

SEQ ID NO: 2021 - DNA, 58 bp, Human herpesvirus 4
aaaggagatcaaccaatagagtccaccagttttgttgcagatagagagcaataatgag

SEQ ID NO: 2022 - DNA, 55 bp, Human herpesvirus 4
gccagagaatctccaataagtagatccagagacctaagactgcgttgaaaaaaga

SEQ ID NO: 2023 - DNA, 56 bp, Human herpesvirus 4
gaaaagtgggggtgtggtaaataattcccagggaatgttagatcttaccaagtaag

SEQ ID NO: 2024 - DNA, 45 bp, Human herpesvirus 8
accacctgcaattgagcaaccacaatgactcccaggtctagattg

SEQ ID NO: 2025 - DNA, 53 bp, Human herpesvirus 8
agcacctatcagtgctttagttccatgaaggtaaatgtcaacggggtagaaaa

SEQ ID NO: 2026 - DNA, 57 bp, Human herpesvirus 8
tttagttccatgaaggtaaatgtcaacggggtagaaaacacatttactgacagagac

SEQ ID NO: 2027 - DNA, 56 bp, Human herpesvirus 8
gggtagaaaacacatttactgacagagacgatgttaacaccacagtattcctccaa

SEQ ID NO: 2028 - DNA, 48 bp, Human herpesvirus 8
gtttcccggcatatacagagttaggaccaccgtcaattgcgagatagt

SEQ ID NO: 2029 - DNA, 52 bp, Human herpesvirus 8
atatacagagttaggaccaccgtcaattgcgagatagtggacatgatagcca

SEQ ID NO: 2030 - DNA, 56 bp, Human herpesvirus 8
aattgcgagatagtggacatgatagccaggtctgctgaaccatacaattactttgt

SEQ ID NO: 2031 - DNA, 46 bp, Human herpesvirus 8
atctacggtcgacctgtatccgccaagttcgtaggagacgccattt

SEQ ID NO: 2032 - DNA, 50 bp, Human herpesvirus 8
aatgagataatactgaccaacaaccaggtggaaacctgcaaagacacctg

SEQ ID NO: 2033 - DNA, 60 bp, Human herpesvirus 8
ctgaacacttttatcgccctgaatctatcctttattcaaaacatagacttcaaggccatc

SEQ ID NO: 2034 - DNA, 50 bp, Human herpesvirus 8
atctggacaacaccatagatatgaacaaggagcgcttcgtaagggacttg

SEQ ID NO: 2035 - DNA, 51 bp, Human herpesvirus 8
gtctgagaggatataaacctctgactcaatcgctagacatcagtccggaaa

SEQ ID NO: 2036 - DNA, 55 bp, Human herpesvirus 8
aaacgggggagtgacagtggattcgaggttattgtttgatgtaaatttaggaaac

SEQ ID NO: 2037 - DNA, 47 bp, Human herpesvirus 8
agatcatggattttttcaatccatttatcgacccaactcgcggaggc

SEQ ID NO: 2038 - DNA, 49 bp, Human herpesvirus 8
aatgctcctatgtcgcacctcatattccacgtatacgacatcgtggaga

SEQ ID NO: 2039 - DNA, 54 bp, Human herpesvirus 8
ccccatacacaatcctatcctttgatatagaatgtatgggcgagaagggttttc

SEQ ID NO: 2040 - DNA, 46 bp, Human herpesvirus 8
cgagaagggttttcccaacgcgactcaagacgaggacatgattata

SEQ ID NO: 2041 - DNA, 46 bp, Human herpesvirus 8
cgccttcctcagcatgctccgcgattacaatgtggagtttataacg

SEQ ID NO: 2042 - DNA, 46 bp, Human herpesvirus 8
caacttcatgaggtcccagtcaaaggtcaaaatatcggggatcgtc

SEQ ID NO: 2043 - DNA, 56 bp, Human herpesvirus 8
aaaaagatgacatctcatacaaggacatacccccgctttttaaatctggacctgat

SEQ ID NO: 2044 - DNA, 53 bp, Human herpesvirus 8
gaaactactgtgttattgactcggtcctggttatggatcttctgctacggttt

SEQ ID NO: 2045 - DNA, 54 bp, Human herpesvirus 8
gcactgaaaactattctagacaaacaacaactggccatcaaggttacctgcaac

SEQ ID NO: 2046 - DNA, 45 bp, Human herpesvirus 8
gttgcctctggcatactgccttgcctaaacatagcggagaccgtg

SEQ ID NO: 2047 - DNA, 45 bp, Human herpesvirus 8
ctaaacatagcggagaccgtgacactacaagggcgaaagatgctg

SEQ ID NO: 2048 - DNA, 48 bp, Human herpesvirus 8
gttctgatgaagggcgtagacctcattaggaaaacagcctgtcgtttt

SEQ ID NO: 2049 - DNA, 45 bp, Human herpesvirus 8
tcgttttgtccaggaaaagagcagtcaggtcctggacctcatact

SEQ ID NO: 2050 - DNA, 48 bp, Human herpesvirus 8
ctagaaagtttcctcttgcgctatgtgggacaactagagtccaacctg

SEQ ID NO: 2051 - DNA, 46 bp, Human herpesvirus 8
atcctaggtgactgggagataacggtgtctaactgccggtttactt

SEQ ID NO: 2052 - DNA, 51 bp, Human herpesvirus 8
ctaagaatccccttctctctggatcgactaatacgtgaccatgccatcttt

SEQ ID NO: 2053 - DNA, 55 bp, Human herpesvirus 8
ctaatacgtgaccatgccatctttgggctagtgccaaatattgaggatctgttaa

SEQ ID NO: 2054 - DNA, 48 bp, Human herpesvirus 8
aacgtatacgggatactttcacagtcctgtcccgctctcttttttgga

SEQ ID NO: 2055 - DNA, 45 bp, Human herpesvirus 8
ctcttttttggacctcctgacattcgagtccatggggtgtgaaaa

SEQ ID NO: 2056 - DNA, 46 bp, Human herpesvirus 8
cattcgacagcatgcaagaaggcccgtattcgtttcgtctacagac

SEQ ID NO: 2057 - DNA, 49 bp, Human herpesvirus 8
aacaccttactgtattcaacccacagacacatcctctgaccattcaacg

SEQ ID NO: 2058 - DNA, 47 bp, Human herpesvirus 8
cgtatgggattccgtcattcaccctagccacatcgtcatctctaatc

SEQ ID NO: 2059 - DNA, 53 bp, Human herpesvirus 8
acctacactgcattctacgcttttggggaccaaaataacaaggttaggatctt

SEQ ID NO: 2060 - DNA, 51 bp, Human herpesvirus 8
gcagtttaccgtaactggcattccagtgacatcctcgaacttaaaccaatg

SEQ ID NO: 2061 - DNA, 58 bp, Human herpesvirus 8
attccagtgacatcctcgaacttaaaccaatgctactttctggtaagaaagccaaaaa

SEQ ID NO: 2062 - DNA, 50 bp, Human herpesvirus 8
ctgtaacgccaggcactacatcccagtaatctacagcggaccaaaaatta

SEQ ID NO: 2063 - DNA, 55 bp, Human herpesvirus 8
caaagtcacagccatcgtgtcaaaccactgctgtaactgtgacatatttttagag

SEQ ID NO: 2064 - DNA, 45 bp, Human herpesvirus 8
agcacccctgaaactggtgaacacgagtgatcatcccgtcatatt

SEQ ID NO: 2065 - DNA, 49 bp, Human herpesvirus 8
gactcgcttaaccacaaaaaccattgaacttcctggcggggtaaagata

SEQ ID NO: 2066 - DNA, 58 bp, Human herpesvirus 8
ctttattgctttcaaataaaacggtgttctctcaacctcctacgggctcactagtatt

SEQ ID NO: 2067 - DNA, 52 bp, Human herpesvirus 8
tagtcatggcactcgacaagagtatagtggttaacttcacctccagactctt

SEQ ID NO: 2068 - DNA, 56 bp, Human herpesvirus 8
tatgctcacgtgagacatctccggactacatccaaattatgcagtatctatccaag

SEQ ID NO: 2069 - DNA, 52 bp, Human herpesvirus 8
ctacatccaaattatgcagtatctatccaagtgcacactcgctgtcctggag

SEQ ID NO: 2070 - DNA, 50 bp, Human herpesvirus 8
gcctaacgcggatggatccctctgacaaccttcagataaaaaacgtatat

SEQ ID NO: 2071 - DNA, 54 bp, Human herpesvirus 8
atggatccctctgacaaccttcagataaaaaacgtatatgcccccttttttcag

SEQ ID NO: 2072 - DNA, 51 bp, Human herpesvirus 8
attttttagccgaaaggattccaccattgtgctcgaatccaacggatttga

SEQ ID NO: 2073 - DNA, 45 bp, Human herpesvirus 8
attgtgctcgaatccaacggatttgacctcgtgttccccatggtc

SEQ ID NO: 2074 - DNA, 58 bp, Human herpesvirus 8
cccggatgatgtaaatatggcggaacttgatctatataccaccaatgtgtcatttatg

SEQ ID NO: 2075 - DNA, 47 bp, Human herpesvirus 8
agatgacatcaccaggatgcgcgtcatgttctcctatcttcagagtc

SEQ ID NO: 2076 - DNA, 57 bp, Human herpesvirus 8
gtcatgttctcctatcttcagagtctcagttctatatttaatcttggccccagactg

SEQ ID NO: 2077 - DNA, 48 bp, Human herpesvirus 8
ctgtttctgtgcccccttaatccttacttggtaactccctcaagcatt

SEQ ID NO: 2078 - DNA, 52 bp, Human herpesvirus 8
atgacgcgattttctgtaaactgccctataccgtgcctataatcaacaccac

SEQ ID NO: 2079 - DNA, 49 bp, Human herpesvirus 8
tataccgtgcctataatcaacaccacgtttggacgcatttacccgaact

SEQ ID NO: 2080 - DNA, 45 bp, Human herpesvirus 8
gacggcaggcctacggattactccatggcccttagaagggctttt

SEQ ID NO: 2081 - DNA, 52 bp, Human herpesvirus 8
ttagaagggcttttgcagttatggttaacacgtcatgtgcaggagtgacatt

SEQ ID NO: 2082 - DNA, 45 bp, Human herpesvirus 8
agaaactcagaccgcatcccgtaaccacactgagtgggaaaatct

SEQ ID NO: 2083 - DNA, 59 bp, Human herpesvirus 8
gaaaatctgctggctatgttttctgtgattatctatgccttagatcacaactgtcaccc

SEQ ID NO: 2084 - DNA, 48 bp, Human herpesvirus 8
ctatcgcgagcggcatctttgacgagcgtgactatggattattcatct

SEQ ID NO: 2085 - DNA, 60 bp, Human herpesvirus 8
gttacaccacgattaaaaaccactcactgagatgtctttttaaccgctaagggattatac

SEQ ID NO: 2086 - DNA, 55 bp, Human herpesvirus 8
tttgaattccacccatcctcctcagataggcctcataataatgatgggcaattaa

SEQ ID NO: 2087 - DNA, 60 bp, Human herpesvirus 8
ctcagataggcctcataataatgatgggcaattaagaacacgagatagtgtctcttttgc

SEQ ID NO: 2088 - DNA, 50 bp, Human herpesvirus 8
caattaagaacacgagatagtgtctcttttgcacgaggtattcggcctgc

SEQ ID NO: 2089 - DNA, 48 bp, Human herpesvirus 8
aaacagatgttaggatctgttccactgccgcctgtagaacggaaacat

SEQ ID NO: 2090 - DNA, 52 bp, Human herpesvirus 8
aatttaagtaacaagaaggaagtgacgtccgtcgctaagactgcctctgttc

SEQ ID NO: 2091 - DNA, 47 bp, Human herpesvirus 8
gttcgccacgccaacttctcaaggagttctttctcctggtctataag

SEQ ID NO: 2092 - DNA, 51 bp, Human herpesvirus 8
aacttctcaaggagttctttctcctggtctataagttcttggcgggaaaag

SEQ ID NO: 2093 - DNA, 57 bp, Human herpesvirus 8
aaagtgttctttggacacctgctttataagtaggagtctgtccaaaagattaagggc

SEQ ID NO: 2094 - DNA, 54 bp, Human herpesvirus 8
gttctaggttgtattcctggcaaactgaaaacatccatgtgcccagtaacttac

SEQ ID NO: 2095 - DNA, 58 bp, Human herpesvirus 8
ctgaaaacatccatgtgcccagtaacttacgcatatgcgaagtaagagattgttgaaa

SEQ ID NO: 2096 - DNA, 60 bp, Human herpesvirus 8
agtaacttacgcatatgcgaagtaagagattgttgaaaggtcccaaatacagagtcagaa

SEQ ID NO: 2097 - DNA, 55 bp, Human herpesvirus 8
gattgttgaaaggtcccaaatacagagtcagaagttaaaaagcgcggctcaattt

SEQ ID NO: 2098 - DNA, 60 bp, Human herpesvirus 8
cagaagttaaaaagcgcggctcaatttcaagaatattgtaaaagatccgatcctcacata

SEQ ID NO: 2099 - DNA, 51 bp, Human herpesvirus 8
aagaatattgtaaaagatccgatcctcacatagcgtgggatccagaagtcc

SEQ ID NO: 2100 - DNA, 56 bp, Human herpesvirus 8
gttaatggcaggggctttttaaacttaactatggaagattgtaggtttcctgccag

SEQ ID NO: 2101 - DNA, 54 bp, Human herpesvirus 8
ccattgacactttggatctcgtcttccatcctttcccaaaaagcgtctataaaa

SEQ ID NO: 2102 - DNA, 52 bp, Human herpesvirus 8
gtgtattatctcctggtgggctactggcaatttgttcatgtgtgctaacaac

SEQ ID NO: 2103 - DNA, 54 bp, Human herpesvirus 8
gctactggcaatttgttcatgtgtgctaacaacagggtaatccacttccatttc

SEQ ID NO: 2104 - DNA, 45 bp, Human herpesvirus 8
ctaacaacagggtaatccacttccatttcgtcctcggatgacgac

SEQ ID NO: 2105 - DNA, 49 bp, Human herpesvirus 8
ttccttgctaatctcgttgtccccattatcctcgccagcctgattattt

SEQ ID NO: 2106 - DNA, 46 bp, Human herpesvirus 8
gacgcataggtgttgaagagtctggccttcctgtaggacttgaaag

SEQ ID NO: 2107 - DNA, 45 bp, Human herpesvirus 8
tagatgtaggtcatcgccaaggtcacatctttccggagacctgtt

SEQ ID NO: 2108 - DNA, 49 bp, Human herpesvirus 8
cacatctttccggagacctgtttcgtttcctacaacttcctctcgttaa

SEQ ID NO: 2109 - DNA, 57 bp, Human papillomavirus
taataacaatcttggtttaaaaaataggagggaccgaaaacggttcaaccgaaaacg

SEQ ID NO: 2110 - DNA, 52 bp, Human papillomavirus
gaccgaaaacggttcaaccgaaaacggttgtatataaaccagccctaaaatt

SEQ ID NO: 2111 - DNA, 60 bp, Human papillomavirus
acggttgtatataaaccagccctaaaatttagcaaacgaggcattatggaaagtgcaaat

SEQ ID NO: 2112 - DNA, 60 bp, Human papillomavirus
tgtgcaagacgtttaatctatctatgcatacgttgcaaattaattgtgtgttttgcaaga

SEQ ID NO: 2113 - DNA, 60 bp, Human papillomavirus
aatgcactgaccacagcagagatttattcatatgcatataaacacctaaaggtcctgttt

SEQ ID NO: 2114 - DNA, 60 bp, Human papillomavirus
tgctggatatgcaacaacagttgaagaagaaactaaacaagacatcttagacgtgctaat

SEQ ID NO: 2115 - DNA, 49 bp, Human papillomavirus
gctaattcggtgctacctgtgtcacaaaccgctgtgtgaagtagaaaag

SEQ ID NO: 2116 - DNA, 56 bp, Human papillomavirus
aacatgcatggaagacatgttaccctaaaggatattgtattagacctgcaacctcc

SEQ ID NO: 2117 - DNA, 58 bp, Human papillomavirus
aagtggacggacaagattcacaacctttaaaacaacatttccaaatagtgacctgttg

SEQ ID NO: 2118 - DNA, 54 bp, Human papillomavirus
gaggacagtgggtatgacatggtggactttattgatgacagcaatattacacac

SEQ ID NO: 2119 - DNA, 60 bp, Human papillomavirus
ggactttattgatgacagcaatattacacacaattcactggaagcacaggcattgtttaa

SEQ ID NO: 2120 - DNA, 52 bp, Human papillomavirus
gacacccattatgcgactgtgcaggacctaaaacgaaagtatttaggtagtc

SEQ ID NO: 2121 - DNA, 60 bp, Human papillomavirus
aacgaaagtatttaggtagtccatatgttagtcctataaacactatagccgaggcagtgg

SEQ ID NO: 2122 - DNA, 60 bp, Human papillomavirus
atatgttagtcctataaacactatagccgaggcagtggaaagtgaaataagtccacgatt

SEQ ID NO: 2123 - DNA, 60 bp, Human papillomavirus
aagtgaaataagtccacgattggacgccattaaacttacaagacagccaaaaaaggtaaa

SEQ ID NO: 2124 - DNA, 54 bp, Human papillomavirus
attaaacttacaagacagccaaaaaaggtaaagcgacggctgtttcaaaccagg

SEQ ID NO: 2125 - DNA, 46 bp, Human papillomavirus
cggctgtttcaaaccagggaactaacggacagtggatatggctatt

SEQ ID NO: 2126 - DNA, 60 bp, Human papillomavirus
tggaattgttaaaatgtaaagatttacgggcagcattacttggtaagtttaaagaatgct

SEQ ID NO: 2127 - DNA, 60 bp, Human papillomavirus
atagatttaattaggccatttaaaagtgataaaacaacatgtttagattgggtggtagca

SEQ ID NO: 2128 - DNA, 57 bp, Human papillomavirus
ataacacgccaaacagttattgaacacgggttggcagacagtcagtttaaattaaca

SEQ ID NO: 2129 - DNA, 60 bp, Human papillomavirus
taaattaacagaaatggtgcagtgggcgtatgataatgacatatgcgaggagagtgaaat

SEQ ID NO: 2130 - DNA, 60 bp, Human papillomavirus
gtgtagacattataaacatgcagaaatgaggaagatgtctataaaacaatggataaaaca

SEQ ID NO: 2131 - DNA, 60 bp, Human papillomavirus
aggaagatgtctataaaacaatggataaaacataggggttctaaaatagaaggcacagga

SEQ ID NO: 2132 - DNA, 60 bp, Human papillomavirus
catttttggttgcaaccgttagtagatgctaaggtagcattgttagatgatgcaacacag

SEQ ID NO: 2133 - DNA, 60 bp, Human papillomavirus
tcctatgagtattgacagaaagcataaagcattgacattaattaaatgtccacctctgct

SEQ ID NO: 2134 - DNA, 60 bp, Human papillomavirus
aatgtccacctctgctagtaacgtccaacatagatattactaaagaagataaatataagt

SEQ ID NO: 2135 - DNA, 60 bp, Human papillomavirus
gataaatataagtatttacatactagagtaacaacatttacatttccaaatccattccct

SEQ ID NO: 2136 - DNA, 60 bp, Human papillomavirus
aaatccattcccttttgacagaaatgggaatgcagtgtatgaactgtcaaatacaaactg

SEQ ID NO: 2137 - DNA, 49 bp, Human papillomavirus
tcaagcctagacattcaggattctgaggacgaggaagatggaagcaata

SEQ ID NO: 2138 - DNA, 53 bp, Human papillomavirus
gtagtgccaccattaaaggtgtccgaagcaaaaggacataatgccattgaaat

SEQ ID NO: 2139 - DNA, 60 bp, Human papillomavirus
ccgaagcaaaaggacataatgccattgaaatgcaaatgcatttagaatcattattaagga

SEQ ID NO: 2140 - DNA, 60 bp, Human papillomavirus
gaaatgcaaatgcatttagaatcattattaaggactgagtatagtatggaaccgtggaca

SEQ ID NO: 2141 - DNA, 60 bp, Human papillomavirus
tcattattaaggactgagtatagtatggaaccgtggacattacaagaaacaagttatgaa

SEQ ID NO: 2142 - DNA, 60 bp, Human papillomavirus
ttacaagaaacaagttatgaaatgtggcaaacaccacctaaacgctgttttaaaaaacgg

SEQ ID NO: 2143 - DNA, 60 bp, Human papillomavirus
aaacaccacctaaacgctgttttaaaaaacggggcaaaactgtagaagttaaatttgatg

SEQ ID NO: 2144 - DNA, 60 bp, Human papillomavirus
gggcaaaactgtagaagttaaatttgatggctgtgcaaacaatacaatggattatgtggt

SEQ ID NO: 2145 - DNA, 58 bp, Human papillomavirus
ctgtgcaaacaatacaatggattatgtggtatggacagatgtgtatgtgcaggacaat

SEQ ID NO: 2146 - DNA, 60 bp, Human papillomavirus
caaacattgggaagtatgttatggcagcacagttatatgttctcctgcatctgtatctag

SEQ ID NO: 2147 - DNA, 60 bp, Human papillomavirus
tctcctgcatctgtatctagcactacacaagaagtatccattcctgaatctactacatac

SEQ ID NO: 2148 - DNA, 60 bp, Human papillomavirus
tcaaggtgaatccaattgtttaaagtgttttagatataggctaaatgacagacacagaca

SEQ ID NO: 2149 - DNA, 60 bp, Human papillomavirus
aagtgttttagatataggctaaatgacagacacagacatttatttgatttaatatcatca

SEQ ID NO: 2150 - DNA, 55 bp, Human papillomavirus
gcctcctcaaaggcaccacataaacatgccattgtaactgtaacatatgatagtg

SEQ ID NO: 2151 - DNA, 60 bp, Human papillomavirus
tgtaacatatgatagtgaggaacaaaggcaacagtttttagatgttgtaaaaataccccc

SEQ ID NO: 2152 - DNA, 60 bp, Human papillomavirus
gcaacagtttttagatgttgtaaaaataccccctaccattagccacaaactgggatttat

SEQ ID NO: 2153 - DNA, 60 bp, Human papillomavirus
actgcctgttataattgcatttgttgtatgttttgttagcatcatacttattgtatggat

SEQ ID NO: 2154 - DNA, 60 bp, Human papillomavirus
tttactattgtggctgctattaacaacccccttgcaatttttcctactaactctacttgt

SEQ ID NO: 2155 - DNA, 60 bp, Human papillomavirus
ccttgcaatttttcctactaactctacttgtgtgttactgtcccgcattgtatatacact

SEQ ID NO: 2156 - DNA, 60 bp, Human papillomavirus
gtcccgcattgtatatacactactatattgttaccacacagcaatgatgctaacatgtca

SEQ ID NO: 2157 - DNA, 60 bp, Human papillomavirus
atattgttaccacacagcaatgatgctaacatgtcaatttaatgatggagatacctggct

SEQ ID NO: 2158 - DNA, 60 bp, Human papillomavirus
acacaccaaatgtaagaagtgtaacaaacacaactgtaatgatgattatgtaactatgca

SEQ ID NO: 2159 - DNA, 53 bp, Human papillomavirus
ccccagatgtaattcctaaggtggagcacaacaccattgcagatcaaatatta

SEQ ID NO: 2160 - DNA, 56 bp, Human papillomavirus
cttcggatccatctattgtgtctttaattgaagaatcggcaatcattaacgcaggg

SEQ ID NO: 2161 - DNA, 60 bp, Human papillomavirus
gggtttacaattacatcctctgaaacaactacccctgcaatattggatgtatcagttact

SEQ ID NO: 2162 - DNA, 55 bp, Human papillomavirus
tggaggctaatggacatatattaatttctgcacccactgtaacgtcacaccctat

SEQ ID NO: 2163 - DNA, 60 bp, Human papillomavirus
ccactgtaacgtcacaccctatagaggaaattcctttagatacttttgtggtatcatcta

SEQ ID NO: 2164 - DNA, 58 bp, Human papillomavirus
gcaggttacagaccctgcatttctttccactcctcaacgcttaattacatatgataac

SEQ ID NO: 2165 - DNA, 49 bp, Human papillomavirus
ctgatgaggcttttatggacataattcgtttgcacagacctgccattgc

SEQ ID NO: 2166 - DNA, 60 bp, Human papillomavirus
ccctgttacaaatatatcagatacatatttaacttccacacctaatacagttacacaacc

SEQ ID NO: 2167 - DNA, 50 bp, Human papillomavirus
gtggggtaacaccacagttccattgtcacttcctaatgacctgtttttac

SEQ ID NO: 2168 - DNA, 60 bp, Human papillomavirus
acagttccattgtcacttcctaatgacctgtttttacaatctggccctgatataactttt

SEQ ID NO: 2169 - DNA, 53 bp, Human papillomavirus
tttttacaatctggccctgatataacttttcctactgcacctatgggaacacc

SEQ ID NO: 2170 - DNA, 53 bp, Human papillomavirus
ctttagtcctgtaactcctgctttacctacaggccctgttttcattacaggtt

SEQ ID NO: 2171 - DNA, 60 bp, Human papillomavirus
ctgttttcattacaggttctggattttatttgcatcctgcatggtattttgcacgtaaac

SEQ ID NO: 2172 - DNA, 59 bp, Human papillomavirus
ctgtatccaaagttgttgccacggatgcttatgttactcgcaccaacatattttatcat

SEQ ID NO: 2173 - DNA, 60 bp, Human papillomavirus
atattttatcatgccagcagttctagacttcttgcagtgggacatccttatttttccata

SEQ ID NO: 2174 - DNA, 55 bp, Human papillomavirus
agtgggacatccttatttttccataaaacgggctaacaaaactgttgtgccaaag

SEQ ID NO: 2175 - DNA, 60 bp, Human papillomavirus
atatcaatacagggtatttaaggtggtgttaccagatcctaacaaatttgcattgcctga

SEQ ID NO: 2176 - DNA, 55 bp, Human papillomavirus
aaatttgcattgcctgactcgtctcttttcgatcccacaacacaacgtttagtat

SEQ ID NO: 2177 - DNA, 52 bp, Human papillomavirus
gggacagccattaggtgtgggtgtaagtggacatcctttcctaaataaatat

SEQ ID NO: 2178 - DNA, 60 bp, Human papillomavirus
agtggacatcctttcctaaataaatatgatgatgttgaaaattcagggagtggtggtaac

SEQ ID NO: 2179 - DNA, 54 bp, Human papillomavirus
tattaccagtgttatacaggatggcgatatggttgacacaggctttggtgctat

SEQ ID NO: 2180 - DNA, 60 bp, Human papillomavirus
gctttggtgctatgaattttgctgatttgcagaccaataaatcagatgttcctattgaca

SEQ ID NO: 2181 - DNA, 60 bp, Human papillomavirus
aatcagatgttcctattgacatatgtggcactacatgtaaatatccagattatttacaaa

SEQ ID NO: 2182 - DNA, 55 bp, Human papillomavirus
gtgcctgatacacttataattaagggtagtggaaatcgcacgtctgtagggagta

SEQ ID NO: 2183 - DNA, 50 bp, Human papillomavirus
gagcggctctttggtgtcctctgaggcacaattgtttaataagccatatt

SEQ ID NO: 2184 - DNA, 54 bp, Human papillomavirus
gtgtcctctgaggcacaattgtttaataagccatattggctacaaaaagcccag

SEQ ID NO: 2185 - DNA, 59 bp, Human papillomavirus
ctacaaaaagcccagggacataacaatggtatttgttggggtaatcaactgtttgttac

SEQ ID NO: 2186 - DNA, 60 bp, Human papillomavirus
catgacattatgtgcatccgtaactacatcttccacatacaccaattctgattataaaga

SEQ ID NO: 2187 - DNA, 60 bp, Human papillomavirus
attacattgtctgctgaagtaatggcctatattcacacaatgaatccctctgttttggaa

SEQ ID NO: 2188 - DNA, 46 bp, Human papillomavirus
tataggtatgtgcagtcacaggccattacctgtcaaaagcccactc

SEQ ID NO: 2189 - DNA, 56 bp, Human papillomavirus
aattggatcagtatcctttgggacgcaagtttttgttacaaagtggatatagggga

SEQ ID NO: 2190 - DNA, 48 bp, Human papillomavirus
taaacaattacctcttgttacaccctgtgactcagtggctgttgcacg

SEQ ID NO: 2191 - DNA, 60 bp, Human papillomavirus
tgcccttagcatacactttccaccaatttgttacaacgtgtttcctcttaatcctatata

SEQ ID NO: 2192 - DNA, 60 bp, Human papillomavirus
cggtattgccttactcataaacctgtctttgtgttatacttttatgcactgtagccaact

SEQ ID NO: 2193 - DNA, 57 bp, Human papillomavirus
caatcttagtttaaaaaagaggagggaccgaaaacggttcaaccgaaaacggttata

SEQ ID NO: 2194 - DNA, 60 bp, Human papillomavirus
gttcaaccgaaaacggttatatataaaccagcccaaaaaattagcagacgaggcattatg

SEQ ID NO: 2195 - DNA, 53 bp, Human papillomavirus
gcattatggaaagtaaagatgcctccacgtctgcaacatctatagaccagttg

SEQ ID NO: 2196 - DNA, 56 bp, Human papillomavirus
gttgtgcaagacgtttaatctttctttgcacactctgcaaattcagtgcgtgtttt

SEQ ID NO: 2197 - DNA, 55 bp, Human papillomavirus
caggaatgcactgaccaccgcagagatatatgcatatgcctataagaacctaaag

SEQ ID NO: 2198 - DNA, 59 bp, Human papillomavirus
agatatatgcatatgcctataagaacctaaaggttgtgtggcgagacaactttcccttt

SEQ ID NO: 2199 - DNA, 45 bp, Human papillomavirus
cgagacaactttccctttgcagcgtgtgcctgttgcttagaactg

SEQ ID NO: 2200 - DNA, 60 bp, Human papillomavirus
gaaaaactaaagcacatattgggaaaggcacgcttcataaaactaaataaccagtggaag

SEQ ID NO: 2201 - DNA, 55 bp, Human papillomavirus
ttcataaaactaaataaccagtggaagggtcgttgcttacactgctggacaacat

SEQ ID NO: 2202 - DNA, 55 bp, Human papillomavirus
acaaggtggacaaacaagacgcacaacctttaacacaacattaccaaatactgac

SEQ ID NO: 2203 - DNA, 49 bp, Human papillomavirus
acaacattaccaaatactgacctgttgctgtggatgtgacagcaacgtc

SEQ ID NO: 2204 - DNA, 53 bp, Human papillomavirus
cagacggagacatcagacaactacaagaccttttgctgggcacactaaatatt

SEQ ID NO: 2205 - DNA, 60 bp, Human papillomavirus
ttattgatgacaggcatattacacaaaattctgtggaagcacaggcattgtttaataggc

SEQ ID NO: 2206 - DNA, 54 bp, Human papillomavirus
ttagacgccattaaacttacaacacagccaaaaaaggtaaagcgacggctgttt

SEQ ID NO: 2207 - DNA, 48 bp, Human papillomavirus
gtaaagcgacggctgtttgaaacacgggaattaacggacagtggatat

SEQ ID NO: 2208 - DNA, 60 bp, Human papillomavirus
gagcatgcagacacatcaggaatattagaattactaaaatgtaaggatatacgatctaca

SEQ ID NO: 2209 - DNA, 60 bp, Human papillomavirus
agaattactaaaatgtaaggatatacgatctacattacatggtaagtttaaagactgctt

SEQ ID NO: 2210 - DNA, 60 bp, Human papillomavirus
acattacatggtaagtttaaagactgctttgggctgtcatttgttgatttaattaggcca

SEQ ID NO: 2211 - DNA, 60 bp, Human papillomavirus
ctttgggctgtcatttgttgatttaattaggccatttaaaagtgatagaaccacatgtgc

SEQ ID NO: 2212 - DNA, 53 bp, Human papillomavirus
aatggataacgcgccagaccgttattgaacatagtttggctgacagtcaattt

SEQ ID NO: 2213 - DNA, 60 bp, Human papillomavirus
accgttattgaacatagtttggctgacagtcaatttaaattaactgaaatggtgcagtgg

SEQ ID NO: 2214 - DNA, 60 bp, Human papillomavirus
ggcatatgataatgatatttgtgaagaaagtgagatagcatttgaatatgcacagcgtgg

SEQ ID NO: 2215 - DNA, 56 bp, Human papillomavirus
atttgaatatgcacagcgtggagactttgactccaatgcaagggcctttttaaata

SEQ ID NO: 2216 - DNA, 60 bp, Human papillomavirus
gggcctttttaaatagtaatatgcaggctaaatatgtaaaagattgtgcaattatgtgca

SEQ ID NO: 2217 - DNA, 60 bp, Human papillomavirus
taaagttgacagtgtaggtaactggaagccaattgtgcagtttctaagacatcaaaacat

SEQ ID NO: 2218 - DNA, 52 bp, Human papillomavirus
gccacctgacactgggaagtcgtgcttttgcatgagtttaattaagtttttg

SEQ ID NO: 2219 - DNA, 60 bp, Human papillomavirus
taattaagtttttggggggaacagttattagttatgttaattcctgcagccatttctggc

SEQ ID NO: 2220 - DNA, 58 bp, Human papillomavirus
ttattagttatgttaattcctgcagccatttctggctacagccactaacggatgcaaa

SEQ ID NO: 2221 - DNA, 51 bp, Human papillomavirus
actaacggatgcaaaagtggcattattggatgatgccacacaaccatgttg

SEQ ID NO: 2222 - DNA, 60 bp, Human papillomavirus
acatatatggatacatatatgagaaacctattagatggtaatcctatgagcatagataga

SEQ ID NO: 2223 - DNA, 60 bp, Human papillomavirus
ggtaatcctatgagcatagatagaaaacatagagcattaacattaattaagtgtccaccg

SEQ ID NO: 2224 - DNA, 60 bp, Human papillomavirus
tttacatttccaaatccattcccctttgacagaaatgggaatgcagtatatgaactatca

SEQ ID NO: 2225 - DNA, 60 bp, Human papillomavirus
tgggaatgcagtatatgaactatcagatgcaaactggaaatgtttctttgaaagactgtc

SEQ ID NO: 2226 - DNA, 54 bp, Human papillomavirus
aaactggaaatgtttctttgaaagactgtcgtccagcctagacattgaggattc

SEQ ID NO: 2227 - DNA, 49 bp, Human papillomavirus
ctagacattgaggattcagaggacgaggaagatggaagcaatagccaag

SEQ ID NO: 2228 - DNA, 60 bp, Human papillomavirus
gactaaaggacataatgctattgaaatgcaaatgcatttagaatccttagcaaaaactca

SEQ ID NO: 2229 - DNA, 51 bp, Human papillomavirus
gtgtggaaccttggacattacaggacaccagttatgaaatgtggctaacac

SEQ ID NO: 2230 - DNA, 60 bp, Human papillomavirus
tgctttaaaaaacagggaaatactgtggaggtaaaatttgatggctgtgaagacaatgta

SEQ ID NO: 2231 - DNA, 60 bp, Human papillomavirus
aatttgatggctgtgaagacaatgtaatggagtatgtggtatggacacatatatacctgc

SEQ ID NO: 2232 - DNA, 57 bp, Human papillomavirus
tatggacacatatatacctgcaggacaacgactcatgggtaaaagtaactagttccg

SEQ ID NO: 2233 - DNA, 60 bp, Human papillomavirus
caatcattgggaagtatgttatggcagcacagttatatgttctcctgcatctgtatctag

SEQ ID NO: 2234 - DNA, 45 bp, Human papillomavirus
accgcccctacagtgtccgcctgcaccacggaagacggcgtgtcg

SEQ ID NO: 2235 - DNA, 45 bp, Human papillomavirus
ctaggaagcgagcacgtggaccgtccactaacaacaccctgtgtg

SEQ ID NO: 2236 - DNA, 56 bp, Human papillomavirus
aatcaacaacatcgtcactgacaattacaacaagcaccaaagaaggaacaactgtc

SEQ ID NO: 2237 - DNA, 58 bp, Human papillomavirus
attgggcctcacctgaggcaccacataaaaatgcaattgtaacattaacatatagcag

SEQ ID NO: 2238 - DNA, 60 bp, Human papillomavirus
tgcaattgtaacattaacatatagcagtgaggaacaacgtcagcaatttttaaacagtgt

SEQ ID NO: 2239 - DNA, 60 bp, Human papillomavirus
gcaacaactacaacattgatattgcctgttgttattgcatttgcagtatgtattcttagt

SEQ ID NO: 2240 - DNA, 60 bp, Human papillomavirus
cgcaacaataatggtgatgttaacctgtcacttaaatgatggtgatacatggttgtttct

SEQ ID NO: 2241 - DNA, 60 bp, Human papillomavirus
tgctaagtgtaaatcaaaccgcaatactactgtggattatgtgtatatgtcacatggtga

SEQ ID NO: 2242 - DNA, 51 bp, Human papillomavirus
ttatatataatgaaacctagggcacgcagacgtaaacgtgcgtcagccaca

SEQ ID NO: 2243 - DNA, 60 bp, Human papillomavirus
cccagatgtaattcctaaagttgaacatactactattgcagatcaaatattaaaatgggg

SEQ ID NO: 2244 - DNA, 60 bp, Human papillomavirus
ggtggctttactataacatcatctgaatcgactacacctgctattttagatgtgtctgtt

SEQ ID NO: 2245 - DNA, 58 bp, Human papillomavirus
atcgactacacctgctattttagatgtgtctgttaccaatcacactaccactagtgtg

SEQ ID NO: 2246 - DNA, 58 bp, Human papillomavirus
aatcacactaccactagtgtgtttcaaaatcccctgtttacagaaccgtctgtaatac

SEQ ID NO: 2247 - DNA, 58 bp, Human papillomavirus
agtggtcacatacttatatctgccccaacaataacatcccaacatgtagaagacattc

SEQ ID NO: 2248 - DNA, 60 bp, Human papillomavirus
aaccctgtctatgaaggagaagatgtaagtttacaatttacccatgagtctatccacaat

SEQ ID NO: 2249 - DNA, 57 bp, Human papillomavirus
ggacaacatataggtgcccgcatacattattttcaggacatttcaccagttacacaa

SEQ ID NO: 2250 - DNA, 58 bp, Human papillomavirus
ctctagtggctgcagaaaatgacacgtttgatatttatgctgaaccatttgaccctat

SEQ ID NO: 2251 - DNA, 58 bp, Human papillomavirus
gtccaacattctgttacacagtcttatcttacctccacacctaataccctttcacaat

SEQ ID NO: 2252 - DNA, 53 bp, Human papillomavirus
ttatcttacctccacacctaataccctttcacaatcgtggggtaataccacag

SEQ ID NO: 2253 - DNA, 48 bp, Human papillomavirus
ctttcacaatcgtggggtaataccacagtcccattgtcaatccctagt

SEQ ID NO: 2254 - DNA, 47 bp, Human papillomavirus
caatccctagtgactggtttgtgcagtctgggcctgacataactttt

SEQ ID NO: 2255 - DNA, 49 bp, Human papillomavirus
ctgggcctgacataacttttcctactgcatctatgggaacaccctttag

SEQ ID NO: 2256 - DNA, 53 bp, Human papillomavirus
cttttcctactgcatctatgggaacaccctttagtcctgtaactcctgcttta

SEQ ID NO: 2257 - DNA, 56 bp, Human papillomavirus
taaacgtattcccttattttttacagatgtggcggcctagcgacagcacagtatat

SEQ ID NO: 2258 - DNA, 57 bp, Human papillomavirus
gtatccaaggttgttgccacggatgcgtatgttaaacgcaccaacatattttatcat

SEQ ID NO: 2259 - DNA, 57 bp, Human papillomavirus
tttaaggtagtgttgccagatcctaacaagtttgcattacctgattcatccctgttt

SEQ ID NO: 2260 - DNA, 52 bp, Human papillomavirus
tttgcattacctgattcatccctgtttgaccccactacacagcgtttagtat

SEQ ID NO: 2261 - DNA, 45 bp, Human papillomavirus
gtttgaccccactacacagcgtttagtatgggcgtgcacagggtt

SEQ ID NO: 2262 - DNA, 45 bp, Human papillomavirus
cagggttggaggtaggcaggggtcaacctttaggcgttggtgtta

SEQ ID NO: 2263 - DNA, 51 bp, Human papillomavirus
ggtcaacctttaggcgttggtgttagtgggcatccattgctaaacaaatat

SEQ ID NO: 2264 - DNA, 60 bp, Human papillomavirus
gcatccattgctaaacaaatatgatgatgtagaaaatagtggtgggtatggtggtaatcc

SEQ ID NO: 2265 - DNA, 53 bp, Human papillomavirus
agtgttatacaggatggggacatggttgatacaggctttggtgctatgaattt

SEQ ID NO: 2266 - DNA, 60 bp, Human papillomavirus
gacatggttgatacaggctttggtgctatgaattttgcagacttacaaaccaataaatcg

SEQ ID NO: 2267 - DNA, 60 bp, Human papillomavirus
atgaattttgcagacttacaaaccaataaatcggatgttccccttgatatttgtggaact

SEQ ID NO: 2268 - DNA, 60 bp, Human papillomavirus
ataaatcggatgttccccttgatatttgtggaactgtctgcaaatatcctgattatttgc

SEQ ID NO: 2269 - DNA, 51 bp, Human papillomavirus
gctcagggacataacaatggtatttgctggggaaaccacttgtttgttact

SEQ ID NO: 2270 - DNA, 60 bp, Human papillomavirus
tgcatctgtgtctaaatctgctacatacactaattcagattataaggaatacatgcgcca

SEQ ID NO: 2271 - DNA, 58 bp, Human papillomavirus
gaattagatcagtttccccttggacgtaagtttttattgcaaagtggatatcgaggac

SEQ ID NO: 2272 - DNA, 57 bp, Human papillomavirus
catgtataaaactaagggcgtaaccgaaatcggttgaaccgaaaccggttagtataa

SEQ ID NO: 2273 - DNA, 60 bp, Human papillomavirus
aaaccggttagtataaaagcagacattttatgcaccaaaagagaactgcaatgtttcagg

SEQ ID NO: 2274 - DNA, 60 bp, Human papillomavirus
cgtgaggtatatgactttgcttttcgggatttatgcatagtatatagagatgggaatcca

SEQ ID NO: 2275 - DNA, 60 bp, Human papillomavirus
tggaacaacattagaacagcaatacaacaaaccgttgtgtgatttgttaattaggtgtat

SEQ ID NO: 2276 - DNA, 60 bp, Human papillomavirus
gcatggagatacacctacattgcatgaatatatgttagatttgcaaccagagacaactga

SEQ ID NO: 2277 - DNA, 55 bp, Human papillomavirus
acagagcccattacaatattgtaaccttttgttgcaagtgtgactctacgcttcg

SEQ ID NO: 2278 - DNA, 52 bp, Human papillomavirus
cacactaggaattgtgtgccccatctgttctcagaaaccataatctaccatg

SEQ ID NO: 2279 - DNA, 60 bp, Human papillomavirus
tgacgagaacgaaaatgacagtgatacaggtgaagatttggtagattttatagtaaatga

SEQ ID NO: 2280 - DNA, 60 bp, Human papillomavirus
acaggtgaagatttggtagattttatagtaaatgataatgattatttaacacaggcagaa

SEQ ID NO: 2281 - DNA, 50 bp, Human papillomavirus
cagaaacagagacagcacatgcgttgtttactgcacaggaagcaaaacaa

SEQ ID NO: 2282 - DNA, 60 bp, Human papillomavirus
gtatttggtagtccacttagtgatattagtggatgtgtagacaataatattagtcctaga

SEQ ID NO: 2283 - DNA, 48 bp, Human papillomavirus
aatactgaagtggaaactcagcagatgttacaggtagaagggcgccat

SEQ ID NO: 2284 - DNA, 51 bp, Human papillomavirus
ttacaggtagaagggcgccatgagactgaaacaccatgtagtcagtatagt

SEQ ID NO: 2285 - DNA, 60 bp, Human papillomavirus
actagtaatgcaaaggcagcaatgttagcaaaatttaaagagttatacggggtgagtttt

SEQ ID NO: 2286 - DNA, 60 bp, Human papillomavirus
gaaaaattgctgtctaaactattatgtgtgtctccaatgtgtatgatgatagagcctcca

SEQ ID NO: 2287 - DNA, 60 bp, Human papillomavirus
atcaaatattagtgaagtgtatggagacacgccagaatggatacaaagacaaacagtatt

SEQ ID NO: 2288 - DNA, 60 bp, Human papillomavirus
gcagacactaatagtaatgcaagtgcctttctaaaaagtaattcacaggcaaaaattgta

SEQ ID NO: 2289 - DNA, 60 bp, Human papillomavirus
tgatagggtagatgatggaggtgattggaagcaaattgttatgtttttaaggtatcaagg

SEQ ID NO: 2290 - DNA, 60 bp, Human papillomavirus
tgagtttaatgaaatttctgcaagggtctgtaatatgttttgtaaattctaaaagccatt

SEQ ID NO: 2291 - DNA, 60 bp, Human papillomavirus
ttctaaaagccatttttggttacaaccattagcagatgccaaaataggtatgttagatga

SEQ ID NO: 2292 - DNA, 60 bp, Human papillomavirus
tctaggtggccttatttacataatagattggtggtgtttacatttcctaatgagtttcca

SEQ ID NO: 2293 - DNA, 54 bp, Human papillomavirus
gataagaactggaaatcctttttctcaaggacgtggtccagattaagtttgcac

SEQ ID NO: 2294 - DNA, 59 bp, Human papillomavirus
aaggaaaacgatggagactctttgccaacgtttaaatgtgtgtcaggacaaaatactaa

SEQ ID NO: 2295 - DNA, 60 bp, Human papillomavirus
gcgcctagaatgtgctatttattacaaggccagagaaatgggatttaaacatattaacca

SEQ ID NO: 2296 - DNA, 57 bp, Human papillomavirus
agaaatgggatttaaacatattaaccaccaagtggtgccaacactggctgtatcaaa

SEQ ID NO: 2297 - DNA, 60 bp, Human papillomavirus
ccaacactggctgtatcaaagaataaagcattacaagcaattgaactgcaactaacgtta

SEQ ID NO: 2298 - DNA, 60 bp, Human papillomavirus
gaactgcaactaacgttagaaacaatatataactcacaatatagtaatgaaaagtggaca

SEQ ID NO: 2299 - DNA, 60 bp, Human papillomavirus
acaatatataactcacaatatagtaatgaaaagtggacattacaagacgttagccttgaa

SEQ ID NO: 2300 - DNA, 60 bp, Human papillomavirus
catggatatacagtggaagtgcagtttgatggagacatatgcaatacaatgcattataca

SEQ ID NO: 2301 - DNA, 60 bp, Human papillomavirus
actgtggtagagggtcaagttgactattatggtttatattatgttcatgaaggaatacga

SEQ ID NO: 2302 - DNA, 60 bp, Human papillomavirus
caggtaatattatgtcctacatctgtgtttagcagcaacgaagtatcctctcctgaaatt

SEQ ID NO: 2303 - DNA, 45 bp, Human papillomavirus
ccttgggcaccgaagaaacacagacgactatccagcgaccaagat

SEQ ID NO: 2304 - DNA, 45 bp, Human papillomavirus
cctgccacaccactaagttgttgcacagagactcagtggacagtg

SEQ ID NO: 2305 - DNA, 60 bp, Human papillomavirus
gcaacgtgaccaatttttgtctcaagttaaaataccaaaaactattacagtgtctactgg

SEQ ID NO: 2306 - DNA, 60 bp, Human papillomavirus
tgtctgtgtctacatacacatcattaataatattggtattactattgtggataacagcag

SEQ ID NO: 2307 - DNA, 53 bp, Human papillomavirus
aaacgttctgcaaaacgcacaaaacgtgcatcggctacccaactttataaaac

SEQ ID NO: 2308 - DNA, 60 bp, Human papillomavirus
cctgacattatacctaaggttgaaggcaaaactattgctgaacaaatattacaatatgga

SEQ ID NO: 2309 - DNA, 60 bp, Human papillomavirus
ggcaaaactattgctgaacaaatattacaatatggaagtatgggtgtattttttggtggg

SEQ ID NO: 2310 - DNA, 57 bp, Human papillomavirus
ctttaacagtagatcctgtgggcccttctgatccttctatagtttctttagtggaag

SEQ ID NO: 2311 - DNA, 60 bp, Human papillomavirus
cccttctgatccttctatagtttctttagtggaagaaactagttttattgatgctggtgc

SEQ ID NO: 2312 - DNA, 60 bp, Human papillomavirus
acttcaactgataccacacctgctatattagatattaataatactgttactactgttact

SEQ ID NO: 2313 - DNA, 60 bp, Human papillomavirus
aataatactgttactactgttactacacataataatcccactttcactgacccatctgta

SEQ ID NO: 2314 - DNA, 60 bp, Human papillomavirus
attcctatggatacatttattgttagcacaaaccctaacacagtaactagtagcacaccc

SEQ ID NO: 2315 - DNA, 49 bp, Human papillomavirus
gttagcacaaaccctaacacagtaactagtagcacacccataccagggt

SEQ ID NO: 2316 - DNA, 54 bp, Human papillomavirus
agtggcacgcctaggattatatagtcgcacaacacaacaggttaaagttgtaga

SEQ ID NO: 2317 - DNA, 60 bp, Human papillomavirus
acaacaggttaaagttgtagaccctgcttttgtaaccactcccactaaacttattacata

SEQ ID NO: 2318 - DNA, 58 bp, Human papillomavirus
ctccagatcctgactttttggatatagttgctttacataggccagcattaacctctag

SEQ ID NO: 2319 - DNA, 60 bp, Human papillomavirus
tcctgcagaagaaatagaattacaaactataacaccttctacatatactaccacttcaca

SEQ ID NO: 2320 - DNA, 60 bp, Human papillomavirus
tcacatgcagcctcacctacttctattaataatggattatatgatatttatgcagatgac

SEQ ID NO: 2321 - DNA, 60 bp, Human papillomavirus
tggtgcatacaatattcctttagtatcaggtcctgatatacccattaatataactgacca

SEQ ID NO: 2322 - DNA, 60 bp, Human papillomavirus
ttccagggtctccacaatatacaattattgctgatgcaggtgacttttatttacatccta

SEQ ID NO: 2323 - DNA, 60 bp, Human papillomavirus
cccagtatctaaggttgtaagcacggatgaatatgttgcacgcacaaacatatattatca

SEQ ID NO: 2324 - DNA, 60 bp, Human papillomavirus
gggtatttagaatacatttacctgaccccaataagtttggttttcctgacacctcatttt

SEQ ID NO: 2325 - DNA, 60 bp, Human papillomavirus
tgcaggtgtggataatagagaatgtatatctatggattacaaacaaacacaattgtgttt

SEQ ID NO: 2326 - DNA, 60 bp, Human papillomavirus
atctatggattacaaacaaacacaattgtgtttaattggttgcaaaccacctatagggga

SEQ ID NO: 2327 - DNA, 60 bp, Human papillomavirus
tccaccattagagttaataaacacagttattcaggatggtgatatggttcatactggctt

SEQ ID NO: 2328 - DNA, 60 bp, Human papillomavirus
gttctatggttacctctgatgcccaaatattcaataaaccttattggttacaacgagcac

SEQ ID NO: 2329 - DNA, 60 bp, Human papillomavirus
aaatattcaataaaccttattggttacaacgagcacagggccacaataatggcatttgtt

SEQ ID NO: 2330 - DNA, 60 bp, Human papillomavirus
tggggaggaatatgatttacagtttatttttcaactgtgcaaaataaccttaactgcaga

SEQ ID NO: 2331 - DNA, 60 bp, Human papillomavirus
aactgcagacgttatgacatacatacattctatgaattccactattttggaggactggaa

SEQ ID NO: 2332 - DNA, 56 bp, Human papillomavirus
ggaggcacactagaagatacttataggtttgtaacccaggcaattgcttgtcaaaa

SEQ ID NO: 2333 - DNA, 60 bp, Human papillomavirus
ggacgcaaatttttactacaagcaggattgaaggccaaaccaaaatttacattaggaaaa

SEQ ID NO: 2334 - DNA, 60 bp, Human papillomavirus
attgtttcaacacctactaattgtgttgtggttattcattgtatataaactatatttgct

SEQ ID NO: 2335 - DNA, 50 bp, Human papillomavirus
ctgacctgcactgcttgccaaccattccattgttttttacactgcactat

SEQ ID NO: 2336 - DNA, 60 bp, Human papillomavirus
caacgccttacataccgctgttaggcacatatttttggcttgttttaactaacctaattg

SEQ ID NO: 2337 - DNA, 60 bp, Human papillomavirus
ggcacatatttttggcttgttttaactaacctaattgcatatttggcataaggtttaaac

SEQ ID NO: 2338 - DNA, 60 bp, Human papillomavirus
aactaacctaattgcatatttggcataaggtttaaacttctaaggccaactaaatgtcac

SEQ ID NO: 2339 - DNA, 60 bp, Human papillomavirus
aaacttctaaggccaactaaatgtcaccctagttcatacatgaactgtgtaaaggttagt

SEQ ID NO: 2340 - DNA, 60 bp, Human papillomavirus
tcatacatgaactgtgtaaaggttagtcatacattgttcatttgtaaaactgcacatggg

SEQ ID NO: 2341 - DNA, 57 bp, Human papillomavirus
gttcatttgtaaaactgcacatgggtgtgtgcaaaccgattttgggttacacattta

SEQ ID NO: 2342 - DNA, 60 bp, Human papillomavirus
gggtgtgtgcaaaccgattttgggttacacatttacaagcaacttatataataatactaa

SEQ ID NO: 2343 - DNA, 60 bp, Human papillomavirus
tacttttaacaattgtagtatataaaaaagggagtaaccgaaaacggtcgggaccgaaaa

SEQ ID NO: 2344 - DNA, 57 bp, Human papillomavirus
cgaaaacggtgtatataaaagatgtgagaaacacaccacaatactatggcgcgcttt

SEQ ID NO: 2345 - DNA, 60 bp, Human papillomavirus
agacatagaaataacctgtgtatattgcaagacagtattggaacttacagaggtatttga

SEQ ID NO: 2346 - DNA, 60 bp, Human papillomavirus
ggtatttgaatttgcatttaaagatttatttgtggtgtatagagacagtataccccatgc

SEQ ID NO: 2347 - DNA, 60 bp, Human papillomavirus
agatttatttgtggtgtatagagacagtataccccatgctgcatgccataaatgtataga

SEQ ID NO: 2348 - DNA, 60 bp, Human papillomavirus
gctgcatgccataaatgtatagatttttattctagaattagagaattaagacattattca

SEQ ID NO: 2349 - DNA, 60 bp, Human papillomavirus
agacattattcagactctgtgtatggagacacattggaaaaactaactaacactgggtta

SEQ ID NO: 2350 - DNA, 60 bp, Human papillomavirus
acattggaaaaactaactaacactgggttatacaatttattaataaggtgcctgcggtgc

SEQ ID NO: 2351 - DNA, 47 bp, Human papillomavirus
gcggtgccagaaaccgttgaatccagcagaaaaacttagacacctta

SEQ ID NO: 2352 - DNA, 49 bp, Human papillomavirus
gagcacgacaggaacgactccaacgacgcagagaaacacaagtataata

SEQ ID NO: 2353 - DNA, 60 bp, Human papillomavirus
acgcagagaaacacaagtataatattaagtatgcatggacctaaggcaacattgcaagac

SEQ ID NO: 2354 - DNA, 58 bp, Human papillomavirus
atggacctaaggcaacattgcaagacattgtattgcatttagagccccaaaatgaaat

SEQ ID NO: 2355 - DNA, 52 bp, Human papillomavirus
aaatgaaattccggttgaccttctatgtcacgagcaattaagcgactcagag

SEQ ID NO: 2356 - DNA, 60 bp, Human papillomavirus
taagcgactcagaggaagaaaacgatgaaatagatggagttaatcatcaacatttaccag

SEQ ID NO: 2357 - DNA, 55 bp, Human papillomavirus
acgaggacgaaaatgcaacagacacagggtcggatatggtagattttattgatac

SEQ ID NO: 2358 - DNA, 54 bp, Human papillomavirus
aggtccacaatgatgcacaagtgttgcatgttttaaaacgaaagtttgcaggag

SEQ ID NO: 2359 - DNA, 56 bp, Human papillomavirus
ttacaatatcagatagtggctatggctgttctgaagtggaagcaacacagattcag

SEQ ID NO: 2360 - DNA, 60 bp, Human papillomavirus
aaacccaacaatagcagaaggatttaaaacactaatacagccatttatattatatgccca

SEQ ID NO: 2361 - DNA, 60 bp, Human papillomavirus
acactaatacagccatttatattatatgcccatattcaatgtctagactgtaaatgggga

SEQ ID NO: 2362 - DNA, 60 bp, Human papillomavirus
cccatattcaatgtctagactgtaaatggggagtattaatattagccctgttgcgttaca

SEQ ID NO: 2363 - DNA, 60 bp, Human papillomavirus
gcagcactatattggtatagaacaggaatatcaaatattagtgaagtaatgggagacaca

SEQ ID NO: 2364 - DNA, 60 bp, Human papillomavirus
gacacacctgagtggatacaaagacttactattatacaacatggaatagatgatagcaat

SEQ ID NO: 2365 - DNA, 60 bp, Human papillomavirus
cgacaaatgaatatgtcacagtggatacgatttagatgttcaaaaatagatgaaggggga

SEQ ID NO: 2366 - DNA, 60 bp, Human papillomavirus
atacgatttagatgttcaaaaatagatgaagggggagattggagaccaatagtgcaattc

SEQ ID NO: 2367 - DNA, 60 bp, Human papillomavirus
tggaatgagttttatacactttatacaaggagcagtaatatcatttgtgaattccactag

SEQ ID NO: 2368 - DNA, 60 bp, Human papillomavirus
tatcatttgtgaattccactagtcatttttggttggaaccgttaacagatactaaggtgg

SEQ ID NO: 2369 - DNA, 50 bp, Human papillomavirus
ttaacagatactaaggtggccatgttagatgatgcaacgaccacgtgttg

SEQ ID NO: 2370 - DNA, 60 bp, Human papillomavirus
cacgtgttggacatactttgatacctatatgagaaatgcgttagatggcaatccaataag

SEQ ID NO: 2371 - DNA, 60 bp, Human papillomavirus
ggcaatccaataagtattgatagaaagcacaaaccattaatacaactaaaatgtcctcca

SEQ ID NO: 2372 - DNA, 60 bp, Human papillomavirus
aaatgtcctccaatactactaaccacaaatatacatccagcaaaggataatagatggcca

SEQ ID NO: 2373 - DNA, 60 bp, Human papillomavirus
ccagcaaaggataatagatggccatatttagaaagtagaataacagtatttgaatttcca

SEQ ID NO: 2374 - DNA, 45 bp, Human papillomavirus
aagaggaagatgcagacaccgaaggaaaccctttcggaacgttta

SEQ ID NO: 2375 - DNA, 55 bp, Human papillomavirus
cctttcggaacgtttaagttgcgtgcaggacaaaatcatagaccactatgaaaat

SEQ ID NO: 2376 - DNA, 60 bp, Human papillomavirus
cgtgcaggacaaaatcatagaccactatgaaaatgacagtaaagacatagacagccaaat

SEQ ID NO: 2377 - DNA, 60 bp, Human papillomavirus
tgaaaatgacagtaaagacatagacagccaaatacagtattggcaactaatacgttggga

SEQ ID NO: 2378 - DNA, 60 bp, Human papillomavirus
aaatacagtattggcaactaatacgttgggaaaatgcaatattctttgcagcaagggaac

SEQ ID NO: 2379 - DNA, 49 bp, Human papillomavirus
gatacaaaaccgaggattggacactgcaagacacatgcgaggaactatg

SEQ ID NO: 2380 - DNA, 60 bp, Human papillomavirus
acaattgtatgacctatgtagcatgggacagtgtgtattatatgactgatgcaggaacat

SEQ ID NO: 2381 - DNA, 53 bp, Human papillomavirus
aacatgggacaaaaccgctacctgtgtaagtcacaggggattgtattatgtaa

SEQ ID NO: 2382 - DNA, 55 bp, Human papillomavirus
acagattgcgaaaacatagcgaccactatagagatatatcatccacctggcattg

SEQ ID NO: 2383 - DNA, 55 bp, Human papillomavirus
tatagagatatatcatccacctggcattggacaggtgcaggcaatgaaaaaacag

SEQ ID NO: 2384 - DNA, 56 bp, Human papillomavirus
gtatgcatgggtattggtatttgtgtatattgtggtaataacgtcccctgccacag

SEQ ID NO: 2385 - DNA, 55 bp, Human papillomavirus
gcacgacgcaaacgggcttcggtaactgacttatataaaacatgtaaacaatctg

SEQ ID NO: 2386 - DNA, 58 bp, Human papillomavirus
cacgttagcagataaaatattgcaatggtcaagccttggtatatttttgggtggactt

SEQ ID NO: 2387 - DNA, 56 bp, Human papillomavirus
ccatctattgttacattaatagaggactccagtgtggttacatcaggtgcacctag

SEQ ID NO: 2388 - DNA, 58 bp, Human papillomavirus
ttcgtctacctctgtgtctatttccacaaccaattttaccaatcctgcattttctgat

SEQ ID NO: 2389 - DNA, 59 bp, Human papillomavirus
caaccaattttaccaatcctgcattttctgatccgtccattattgaagttccacaaact

SEQ ID NO: 2390 - DNA, 57 bp, Human papillomavirus
cctacatctggaacacatgggtatgaggaaatacctttacaaacatttgcttcttct

SEQ ID NO: 2391 - DNA, 47 bp, Human papillomavirus
ctaccaacaagtgtcagtggctaaccctgagtttcttacacgtccat

SEQ ID NO: 2392 - DNA, 56 bp, Human papillomavirus
cagtggctaaccctgagtttcttacacgtccatcctctttaattacatatgacaac

SEQ ID NO: 2393 - DNA, 60 bp, Human papillomavirus
ctgtggacactacattaacatttgatcctcgtagtgatgttcctgattcagattttatgg

SEQ ID NO: 2394 - DNA, 60 bp, Human papillomavirus
ttgatcctcgtagtgatgttcctgattcagattttatggatattatccgtctacataggc

SEQ ID NO: 2395 - DNA, 53 bp, Human papillomavirus
attttatggatattatccgtctacataggcctgctttaacatccaggcgtggg

SEQ ID NO: 2396 - DNA, 52 bp, Human papillomavirus
tattgcaccttccccagaatatattgaactgcagcctttagtatctgccacg

SEQ ID NO: 2397 - DNA, 51 bp, Human papillomavirus
ctttaacctcctcttgggatgtgcctgtatacacgggtcctgatattacat

SEQ ID NO: 2398 - DNA, 59 bp, Human papillomavirus
tgtatacacgggtcctgatattacattaccatctactacctctgtatggcccattgtat

SEQ ID NO: 2399 - DNA, 59 bp, Human papillomavirus
acaataccgtatatcttccacctccttctgtggcaagagttgtaaataccgatgattat

SEQ ID NO: 2400 - DNA, 60 bp, Human papillomavirus
ggcaataagcaggatattcctaaggtttctgcataccaatatagagtatttagggtgcag

SEQ ID NO: 2401 - DNA, 60 bp, Human papillomavirus
agagtatttagggtgcagttacctgacccaaataaatttggtttacctgatactagtatt

SEQ ID NO: 2402 - DNA, 60 bp, Human papillomavirus
cctgacccaaataaatttggtttacctgatactagtatttataatcctgaaacacaacgt

SEQ ID NO: 2403 - DNA, 55 bp, Human papillomavirus
tactagtatttataatcctgaaacacaacgtttagtgtgggcctgtgctggagtg

SEQ ID NO: 2404 - DNA, 55 bp, Human papillomavirus
cgccacgtctaatgtttctgaggacgttagggacaatgtgtctgtagattataag

SEQ ID NO: 2405 - DNA, 60 bp, Human papillomavirus
tctgaggacgttagggacaatgtgtctgtagattataagcagacacagttatgtattttg

SEQ ID NO: 2406 - DNA, 48 bp, Human papillomavirus
gaacactgggctaaaggcactgcttgtaaatcgcgtcctttatcacag

SEQ ID NO: 2407 - DNA, 46 bp, Human papillomavirus
taaaggcactgcttgtaaatcgcgtcctttatcacagggcgattgc

SEQ ID NO: 2408 - DNA, 52 bp, Human papillomavirus
tttatcacagggcgattgcccccctttagaacttaaaaacacagttttggaa

SEQ ID NO: 2409 - DNA, 60 bp, Human papillomavirus
tagaacttaaaaacacagttttggaagatggtgatatggtagatactggatatggtgcca

SEQ ID NO: 2410 - DNA, 60 bp, Human papillomavirus
ttgtcagtctatttgtaaatatcctgattatttacaaatgtctgcagatccttatgggga

SEQ ID NO: 2411 - DNA, 54 bp, Human papillomavirus
ctatgggtgacactgtgcctcaatccttatatattaaaggcacaggtatgcctg

SEQ ID NO: 2412 - DNA, 60 bp, Human papillomavirus
tctgactcccagttgtttaataaaccatattggttacataaggcacagggtcataacaat

SEQ ID NO: 2413 - DNA, 60 bp, Human papillomavirus
ggttacataaggcacagggtcataacaatggtgtttgctggcataatcaattatttgtta

SEQ ID NO: 2414 - DNA, 60 bp, Human papillomavirus
cctgggcaatatgatgctaccaaatttaagcagtatagcagacatgttgaggaatatgat

SEQ ID NO: 2415 - DNA, 60 bp, Human papillomavirus
actgcagatgttatgtcctatattcatagtatgaatagcagtattttagaggattggaac

SEQ ID NO: 2416 - DNA, 58 bp, Human papillomavirus
tattacctgtcaaaaggatgctgcaccggctgaaaataaggatccctatgataagtta

SEQ ID NO: 2417 - DNA, 60 bp, Human papillomavirus
tgcaccggctgaaaataaggatccctatgataagttaaagttttggaatgtggatttaaa

SEQ ID NO: 2418 - DNA, 60 bp, Human papillomavirus
tggaatgtggatttaaaggaaaagttttctttagacttagatcaatatccccttggacgt

SEQ ID NO: 2419 - DNA, 46 bp, Human papillomavirus
aatatccccttggacgtaaatttttggttcaggctggattgcgtcg

SEQ ID NO: 2420 - DNA, 45 bp, Hepatitis B virus
ggcctgtattttcctgctggtggctccagttcaggaacactcaac

SEQ ID NO: 2421 - DNA, 49 bp, Hepatitis B virus
gaacactcaaccctgttccaactattgcctctcacatctcgtcaatctc

SEQ ID NO: 2422 - DNA, 45 bp, Hepatitis B virus
gagaacatcacatcaggattcctaggacccctgctcgtgttacag

SEQ ID NO: 2423 - DNA, 52 bp, Hepatitis B virus
ctcacaataccgcagagtctagactcgtggtggacttctctcaattttctag

SEQ ID NO: 2424 - DNA, 45 bp, Hepatitis B virus
ctctcaattttctagggggagcacccgtgtgtcttggccaaaatt

SEQ ID NO: 2425 - DNA, 45 bp, Hepatitis B virus
caatcactcaccaacctcctgtcctccaatttgtcctggttatcg

SEQ ID NO: 2426 - DNA, 60 bp, Hepatitis B virus
tatcatattcctcttcatcctgctgctatgcctcatcttcttattggttcttctggatta

SEQ ID NO: 2427 - DNA, 57 bp, Hepatitis B virus
ctatgcctcatcttcttattggttcttctggattatcaaggtatgttgcccgtttgt

SEQ ID NO: 2428 - DNA, 54 bp, Hepatitis B virus
ttcttctggattatcaaggtatgttgcccgtttgtcctctaattccaggatcaa

SEQ ID NO: 2429 - DNA, 48 bp, Hepatitis B virus
gtattcccatcccatcatcttgggctttcgcaaaatacctatgggagt

SEQ ID NO: 2430 - DNA, 45 bp, Hepatitis B virus
ctttcgcaaaatacctatgggagtgggcctcagtccgtttctctt

SEQ ID NO: 2431 - DNA, 60 bp, Hepatitis B virus
taacaaaacaaagagatggggttattccctgaatttcatgggttatgtaattggaagttg

SEQ ID NO: 2432 - DNA, 56 bp, Hepatitis B virus
gaaagtatgtcagagacttgtaggtcttttaggctttgccgctccatttacacaat

SEQ ID NO: 2433 - DNA, 60 bp, Hepatitis B virus
gttaccctgcattaatgcctttgtatgcatgtatacaagcgaaacaggcttttactttct

SEQ ID NO: 2434 - DNA, 60 bp, Hepatitis B virus
aggcttttactttctcgccaacttacaaggcctttctaagtaaacagtatatgaaccttt

SEQ ID NO: 2435 - DNA, 45 bp, Hepatitis B virus
agtatatgaacctttaccccgttgcccggcaacggcctggtctgt

SEQ ID NO: 2436 - DNA, 45 bp, Hepatitis B virus
tctgtgccaagtgtttgctgacgcaacccccactggctggggctt

SEQ ID NO: 2437 - DNA, 45 bp, Hepatitis B virus
gccatcggccatcagcgcatgcgtgaaacctttgtggctcctctg

SEQ ID NO: 2438 - DNA, 45 bp, Hepatitis B virus
aaacctttgtggctcctctgccgatccatactgcagaactcctag

SEQ ID NO: 2439 - DNA, 45 bp, Hepatitis B virus
ctagccgcttgttttgctcgcagccggtctggagcaaaactcatc

SEQ ID NO: 2440 - DNA, 45 bp, Hepatitis B virus
gacgacccctcgcgaggccgcttgggactgtatcgtccccttctc

SEQ ID NO: 2441 - DNA, 46 bp, Hepatitis B virus
ttctcatctgccggtccgtgtgcacttcgcttcacctctgcacgtt

SEQ ID NO: 2442 - DNA, 45 bp, Hepatitis B virus
gcacttcgcttcacctctgcacgttgcatggagaccaccgtgaac

SEQ ID NO: 2443 - DNA, 45 bp, Hepatitis B virus
aacgcccatcaggtcctgcccaaggtcttacataagaggactctt

SEQ ID NO: 2444 - DNA, 49 bp, Hepatitis B virus
caaggtcttacataagaggactcttggactctcagcaatgtcaacgacc

SEQ ID NO: 2445 - DNA, 50 bp, Hepatitis B virus
aatgtcaacgaccgaccttgaggcctacttcaaagactgtgtgtttaaag

SEQ ID NO: 2446 - DNA, 48 bp, Hepatitis B virus
ttgaggcctacttcaaagactgtgtgtttaaagactgggaggagttgg

SEQ ID NO: 2447 - DNA, 54 bp, Hepatitis B virus
ggggaggagattaggttaaaggtctttgtattaggaggctgtaggcataaattg

SEQ ID NO: 2448 - DNA, 51 bp, Hepatitis B virus
ctcatttttgccttctgacttctttccttccgtccgggatctactagatac

SEQ ID NO: 2449 - DNA, 46 bp, Hepatitis B virus
catacagcactcaggcaagccattctctgctgggggaaattaatga

SEQ ID NO: 2450 - DNA, 60 bp, Hepatitis B virus
agatccagcatccagggatctagtagtcaattatgttaatactaacatgggcctaaagat

SEQ ID NO: 2451 - DNA, 60 bp, Hepatitis B virus
tgttaatactaacatgggcctaaagatcaggcaattattgtggtttcatatttcttgcct

SEQ ID NO: 2452 - DNA, 60 bp, Hepatitis B virus
ttcatatttcttgccttacttttggaagagaaactgtccttgagtatttggtctctttcg

SEQ ID NO: 2453 - DNA, 48 bp, Hepatitis B virus
aaactgtccttgagtatttggtctctttcggagtgtggattcgcactc

SEQ ID NO: 2454 - DNA, 47 bp, Hepatitis B virus
gattcgcactcctccagcctatagaccaccaaatgcccctatcttat

SEQ ID NO: 2455 - DNA, 57 bp, Hepatitis B virus
ctatagaccaccaaatgcccctatcttatcaacacttccggaaactactgttgttag

SEQ ID NO: 2456 - DNA, 45 bp, Hepatitis B virus
aaactactgttgttagacgacgagaccgaggcaggtcccctagaa

SEQ ID NO: 2457 - DNA, 48 bp, Hepatitis B virus
gccgcgtcgcagaagatctcaatctcgggaatctcaatgttagtattc

SEQ ID NO: 2458 - DNA, 60 bp, Hepatitis B virus
atctcaatctcgggaatctcaatgttagtattccttggactcataaggtgggaaatttta

SEQ ID NO: 2459 - DNA, 60 bp, Hepatitis B virus
actcataaggtgggaaattttactgggctttattcttctactgtccctatctttaatcct

SEQ ID NO: 2460 - DNA, 60 bp, Hepatitis B virus
tgtccctatctttaatcctgaatggcaaacaccttcttttcctaaaattcatttacatga

SEQ ID NO: 2461 - DNA, 60 bp, Hepatitis B virus
caccttcttttcctaaaattcatttacatgaagacattgctaataggtgtcagcaatttg

SEQ ID NO: 2462 - DNA, 60 bp, Hepatitis B virus
cagcacaaaatatttgcccttagacaaagggattaaaacttattatcctgatcatgtagt

SEQ ID NO: 2463 - DNA, 60 bp, Hepatitis B virus
caaagggattaaaacttattatcctgatcatgtagttaatcattactttcaaacccgaca

SEQ ID NO: 2464 - DNA, 60 bp, Hepatitis B virus
agttaatcattactttcaaacccgacattatttacatactctttggaaggctgggattct

SEQ ID NO: 2465 - DNA, 45 bp, Hepatitis B virus
atcaaaacctcgcaaaggcatggggacgaacctttctgttcccaa

SEQ ID NO: 2466 - DNA, 48 bp, Hepatitis B virus
atcatcagttggaccctgcattcggagccaattcaaacaatccagatt

SEQ ID NO: 2467 - DNA, 47 bp, Hepatitis B virus
caattcaaacaatccagattgggacttcaaccccatcaaggaccact

SEQ ID NO: 2468 - DNA, 45 bp, Hepatitis B virus
agattgggacttcaaccccatcaaggaccactggccacaagccaa

SEQ ID NO: 2469 - DNA, 45 bp, Hepatitis B virus
aagccaaccaggtaggagtgggagcatttgggccagggttcactc

SEQ ID NO: 2470 - DNA, 45 bp, Hepatitis B virus
cagcctactcccatctctccacctctaagagacagtcatcctcag

SEQ ID NO: 2471 - DNA, 46 bp, Hepatitis B virus
aattccacaacctttcaccaaactctgcaagatcccagagtgagag

SEQ ID NO: 2472 - DNA, 45 bp, Hepatitis B virus
gttcaggagcagtaaaccctgttccgactactgcctctcccttat

SEQ ID NO: 2473 - DNA, 46 bp, Hepatitis B virus
tgttccgactactgcctctcccttatcgtcaatcttctcgaggatt

SEQ ID NO: 2474 - DNA, 45 bp, Hepatitis B virus
cttatcgtcaatcttctcgaggattggggaccctgcgctgaacat

SEQ ID NO: 2475 - DNA, 47 bp, Hepatitis B virus
acatggagaacatcacatcaggattcctaggaccccttctcgtgtta

SEQ ID NO: 2476 - DNA, 51 bp, Hepatitis B virus
cttctcgtgttacaggcggggtttttcttgttgacaagaatcctcacaata

SEQ ID NO: 2477 - DNA, 50 bp, Hepatitis B virus
cacaataccgcagagtctagactcgtggtggacttctctcaattttctag

SEQ ID NO: 2478 - DNA, 50 bp, Hepatitis B virus
gacttctctcaattttctagggggaactaccgtgtgtcttggccaaaatt

SEQ ID NO: 2479 - DNA, 45 bp, Hepatitis B virus
gtgtgtcttggccaaaattcgcagtccccaacctccaatcactca

SEQ ID NO: 2480 - DNA, 45 bp, Hepatitis B virus
caatcactcaccaacctcctgtcctccaacttgtcctggttatcg

SEQ ID NO: 2481 - DNA, 48 bp, Hepatitis B virus
ttatcgctggatgtgtctgcggcgttttatcatcttcctcttcatcct

SEQ ID NO: 2482 - DNA, 56 bp, Hepatitis B virus
gttttatcatcttcctcttcatcctgctgctatgcctcatcttcttgttggttctt

SEQ ID NO: 2483 - DNA, 51 bp, Hepatitis B virus
ttcttctggactatcaaggtatgttgcccgtttgtcctctaattccaggat

SEQ ID NO: 2484 - DNA, 45 bp, Hepatitis B virus
tttgtcctctaattccaggatcctcaaccaccagcacgggaccat

SEQ ID NO: 2485 - DNA, 46 bp, Hepatitis B virus
ctgtattcccatcccatcatcctgggctttcggaaaattcctatgg

SEQ ID NO: 2486 - DNA, 57 bp, Hepatitis B virus
aaagagatggggttactctctgaattttatgggttatgtcattggaagttatgggtc

SEQ ID NO: 2487 - DNA, 51 bp, Hepatitis B virus
gaaagtatgtcaacgaattgtgggtcttttgggttttgctgccccatttac

SEQ ID NO: 2488 - DNA, 60 bp, Hepatitis B virus
atttacacaatgtggttatcctgcgttaatgcccttgtatgcatgtattcaatctaagca

SEQ ID NO: 2489 - DNA, 57 bp, Hepatitis B virus
tttcactttctcgccaacttacaaggcctttctgtgtaaacaatacctgaaccttta

SEQ ID NO: 2490 - DNA, 45 bp, Hepatitis B virus
caacggccaggtctgtgccaagtgtttgctgacgcaacccccact

SEQ ID NO: 2491 - DNA, 45 bp, Hepatitis B virus
gtcatgggccatcagcgcgtgcgtggaaccttttcggctcctctg

SEQ ID NO: 2492 - DNA, 45 bp, Hepatitis B virus
gatccatactgcggaactcctagccgcttgttttgctcgcagcag

SEQ ID NO: 2493 - DNA, 56 bp, Hepatitis B virus
aaacattatcgggactgataactctgttgtcctctcccgcaaatatacatcgtatc

SEQ ID NO: 2494 - DNA, 46 bp, Hepatitis B virus
taggctgtgctgccaactggatcctgcgcgggacgtcctttgttta

SEQ ID NO: 2495 - DNA, 45 bp, Hepatitis B virus
aatcctgcggacgacccttctcggggtcgcttgggactctctcgt

SEQ ID NO: 2496 - DNA, 45 bp, Hepatitis B virus
ttgggactctctcgtccccttctccgtctgccgttccgaccgacc

SEQ ID NO: 2497 - DNA, 45 bp, Hepatitis B virus
gcacctctctttacgcggactccccgtctgtgccttctcatctgc

SEQ ID NO: 2498 - DNA, 45 bp, Hepatitis B virus
cgtctgtgccttctcatctgccggaccgtgtgcacttcgcttcac

SEQ ID NO: 2499 - DNA, 45 bp, Hepatitis B virus
atggagaccaccgtgaacgcccaccgaatgttgcccaaggtctta

SEQ ID NO: 2500 - DNA, 50 bp, Hepatitis B virus
aatgttgcccaaggtcttacataagaggactcttggactctctgcaatgt

SEQ ID NO: 2501 - DNA, 56 bp, Hepatitis B virus
catgcaactttttcacctctgcctaatcatctcttgttcatgtcctactgttcaag

SEQ ID NO: 2502 - DNA, 47 bp, Hepatitis B virus
attgttcacctcaccatactgcactcaggcaagcaattctttgctgg

SEQ ID NO: 2503 - DNA, 60 bp, Hepatitis B virus
agatccagcatctagagacctagtagtcagttatgtcaacactaatatgggcctaaagtt

SEQ ID NO: 2504 - DNA, 60 bp, Hepatitis B virus
gttatgtcaacactaatatgggcctaaagttcaggcaactcttgtggtttcacatttctt

SEQ ID NO: 2505 - DNA, 60 bp, Hepatitis B virus
ttcacatttcttgtctcacttttggaagagaaaccgttatagagtatttggtgtctttcg

SEQ ID NO: 2506 - DNA, 45 bp, Hepatitis B virus
tgttgttagacgacgaggcaggtcccctagaagaagaactccctc

SEQ ID NO: 2507 - DNA, 45 bp, Hepatitis B virus
ctcgcagacgaaggtctcaatcgccgcgtcgcagaagatctcaat

SEQ ID NO: 2508 - DNA, 51 bp, Hepatitis B virus
atctcaatctcgggaacctcaatgttagtattccttggactcataaggtgg

SEQ ID NO: 2509 - DNA, 60 bp, Hepatitis B virus
caccatcttttcctaatatacatttacaccaagacattatcaaaaaatgtgaacagtttg

SEQ ID NO: 2510 - DNA, 60 bp, Hepatitis B virus
aaaaatgtgaacagtttgtaggcccacttacagttaatgagaaaagaagattgcaattga

SEQ ID NO: 2511 - DNA, 60 bp, Hepatitis B virus
gcctgctaggttttatccaaaggttaccaaatatttaccattggataagggtattaaacc

SEQ ID NO: 2512 - DNA, 60 bp, Hepatitis B virus
accttattatccagaacatctagttaatcattacttccaaactagacactatttacacac

SEQ ID NO: 2513 - DNA, 60 bp, Hepatitis B virus
actctatggaaggcgggtatattatataagagagaaacaacacatagcgcctcattttgt

SEQ ID NO: 2514 - DNA, 52 bp, Hepatitis B virus
aacacatagcgcctcattttgtgggtcaccatattcttgggaacaagatcta

SEQ ID NO: 2515 - DNA, 49 bp, Hepatitis B virus
atattcttgggaacaagatctacagcatggggcagaatctttccaccag

SEQ ID NO: 2516 - DNA, 45 bp, Hepatitis B virus
cagaatctttccaccagcaatcctctgggattctttcccgaccac

SEQ ID NO: 2517 - DNA, 45 bp, Hepatitis B virus
attctttcccgaccaccagttggatccagccttcagagcaaacac

SEQ ID NO: 2518 - DNA, 49 bp, Hepatitis B virus
cttcagagcaaacacagcaaatccagattgggacttcaatcccaacaag

SEQ ID NO: 2519 - DNA, 45 bp, Hepatitis B virus
ggagccctcaggctcagggcatactacaaactttgccagcaaatc

SEQ ID NO: 2520 - DNA, 45 bp, Hepatitis B virus
gaaggcagcctaccccgctgtctccacctttgagaaacactcatc

SEQ ID NO: 2521 - DNA, 48 bp, Hepatitis B virus
acatttcaccaagtcctgctagatcccagagtgaggggcctatatttt

SEQ ID NO: 2522 - DNA, 47 bp, Hepatitis B virus
aacagtaaaccctgttgcgactactgcctcacccatatcgtcaatct

SEQ ID NO: 2523 - DNA, 45 bp, Hepatitis B virus
catatcgtcaatctcctcgaggactggggaccctgcaccgaacat

SEQ ID NO: 2524 - DNA, 46 bp, Hepatitis B virus
ctccaatcactcaccaacctcttgtcctccaatttgtcctggctat

SEQ ID NO: 2525 - DNA, 47 bp, Hepatitis B virus
ctaccaaggtatgttgcccgtttgtcctctacttccaggaacatcaa

SEQ ID NO: 2526 - DNA, 45 bp, Hepatitis B virus
ctctacttccaggaacatcaaccaccagcacgggaccatgcaaga

SEQ ID NO: 2527 - DNA, 45 bp, Hepatitis B virus
ctatgggagggggcctcagtccgtttctcctggctcagtttacta

SEQ ID NO: 2528 - DNA, 48 bp, Hepatitis B virus
ctggctcagtttactagtgccatttgttcagtggttcgtagggctttc

SEQ ID NO: 2529 - DNA, 50 bp, Hepatitis B virus
tagggctttcccccactgtttggctttcagttatatggatgatgtggtat

SEQ ID NO: 2530 - DNA, 56 bp, Hepatitis B virus
ctaataaaaccaaacgttggggctactcccttaacttcatgggatatgtaattggc

SEQ ID NO: 2531 - DNA, 52 bp, Hepatitis B virus
ctattgactggaaagtatgtcaaagaattgtgggtcttttgggctttgctgc

SEQ ID NO: 2532 - DNA, 58 bp, Hepatitis B virus
ctttcactttctcgccaacttacaaggcctttctgtgtaaacaatatctgcaccttta

SEQ ID NO: 2533 - DNA, 45 bp, Hepatitis B virus
gaacggctctctgccaagtatttgctgacgcaacccccactggat

SEQ ID NO: 2534 - DNA, 45 bp, Hepatitis B virus
atggggcttggccataggccatcggcgcatgcgtggaacctttgt

SEQ ID NO: 2535 - DNA, 47 bp, Hepatitis B virus
aaactcatcgggactgacaactcggttgttctctctcggaaatacac

SEQ ID NO: 2536 - DNA, 45 bp, Hepatitis B virus
gtctcgcggccgtttgggcctcatccgtccccttcttcatctgcg

SEQ ID NO: 2537 - DNA, 45 bp, Hepatitis B virus
cttctcatctgccggaccgtgtgcacttcgcttcacctctgcacg

SEQ ID NO: 2538 - DNA, 49 bp, Hepatitis B virus
ttgcccaaggtcttacataagaggactcttggactctcagcaatgtcaa

SEQ ID NO: 2539 - DNA, 51 bp, Hepatitis B virus
gtcaacgtccgaccttgaggcatacttcaaagactgcttgtttaaagactg

SEQ ID NO: 2540 - DNA, 55 bp, Hepatitis B virus
catgcaacttttttcacctctgcctaatcatctcatgttcatgtcctactgttca

SEQ ID NO: 2541 - DNA, 45 bp, Hepatitis B virus
cctctgctctgtatagggaggccttagagtctccggaacattgtt

SEQ ID NO: 2542 - DNA, 45 bp, Hepatitis B virus
tgggtgggaagtaatttggaagacccagcatccagggaactagta

SEQ ID NO: 2543 - DNA, 60 bp, Hepatitis B virus
cttacttttggaagagaaactgttttggagtatttggtatcttttggagtgtggattcgc

SEQ ID NO: 2544 - DNA, 48 bp, Hepatitis B virus
gagtatttggtatcttttggagtgtggattcgcactcctcccgcttac

SEQ ID NO: 2545 - DNA, 52 bp, Hepatitis B virus
agaccaccaaatgcccctatcttatcaacacttccggaaactactgttgtta

SEQ ID NO: 2546 - DNA, 45 bp, Hepatitis B virus
ctagaagaagaactccctcgcctcgcagacgaagatctgaatcgc

SEQ ID NO: 2547 - DNA, 60 bp, Hepatitis B virus
cacattcatttacaggaggacattattaatagatgtcaacaatatgtgggccctcttaca

SEQ ID NO: 2548 - DNA, 60 bp, Hepatitis B virus
agatgtcaacaatatgtgggccctcttacagttaatgaaaaaaggagattaaaattaatt

SEQ ID NO: 2549 - DNA, 60 bp, Hepatitis B virus
ggagattaaaattaattatgcctgctaggttttatcctaaacttaccaaatatttgccct

SEQ ID NO: 2550 - DNA, 60 bp, Hepatitis B virus
gttttatcctaaacttaccaaatatttgcccttggataaaggcattaaaccttattatcc

SEQ ID NO: 2551 - DNA, 60 bp, Hepatitis B virus
tgcccttggataaaggcattaaaccttattatcctgaacatgcagttaatcattacttca

SEQ ID NO: 2552 - DNA, 60 bp, Hepatitis B virus
attatcctgaacatgcagttaatcattacttcaaaactaggcattatttacatactctgt

SEQ ID NO: 2553 - DNA, 60 bp, Hepatitis B virus
ctaggcattatttacatactctgtggaaggcgggcattctatataagagagaaactacac

SEQ ID NO: 2554 - DNA, 45 bp, Hepatitis B virus
accagttggaccctgcgttcggagccaactcaaacaatccagatt

SEQ ID NO: 2555 - DNA, 45 bp, Hepatitis B virus
acttcaaccccaacaaggatcgttggccagaggcaaatcaggtag

SEQ ID NO: 2556 - DNA, 45 bp, Hepatitis B virus
gtcttttggggtggagccctcaggctcagggcatattgacaaccg

SEQ ID NO: 2557 - DNA, 45 bp, Hepatitis B virus
ggggcctatattttcctgctggtggctccagttccggaacagtaa

SEQ ID NO: 2558 - DNA, 48 bp, Hepatitis B virus
aacagtaaaccctgttccgactactgcctcacccatatcgtcaatctt

SEQ ID NO: 2559 - DNA, 45 bp, Hepatitis B virus
gactggggaccctgcaccgaacatggagagcacaacatcaggatt

SEQ ID NO: 2560 - DNA, 45 bp, Hepatitis B virus
gagagcacaacatcaggattcctaggacccctgctcgtgttacag

SEQ ID NO: 2561 - DNA, 49 bp, Hepatitis B virus
gctcgtgttacaggcggggtttttcttgttgacaagaatcctcacaata

SEQ ID NO: 2562 - DNA, 54 bp, Hepatitis B virus
atcctcacaataccacagagtctagactcgtggtggacttctctcaattttcta

SEQ ID NO: 2563 - DNA, 45 bp, Hepatitis B virus
aattttctagggggagcacccacgtgtcctggccaaaattcgcag

SEQ ID NO: 2564 - DNA, 45 bp, Hepatitis B virus
caatcactcaccaacctcttgtcctccaacttgtcctggctatcg

SEQ ID NO: 2565 - DNA, 49 bp, Hepatitis B virus
gctatcgctggatgtgtctgcggcgttttatcatattcctcttcatcct

SEQ ID NO: 2566 - DNA, 58 bp, Hepatitis B virus
gttttatcatattcctcttcatcctgctgctatgcctcatcttcttgttggttcttct

SEQ ID NO: 2567 - DNA, 49 bp, Hepatitis B virus
taccaaggtatgttgcccgtttgtcctctacttccaggaacatcaacta

SEQ ID NO: 2568 - DNA, 45 bp, Hepatitis B virus
ctctacttccaggaacatcaactaccagcacgggaccatgcagaa

SEQ ID NO: 2569 - DNA, 45 bp, Hepatitis B virus
ttgtattcccatcccatcatcctgggctttcgcaagattcctatg

SEQ ID NO: 2570 - DNA, 49 bp, Hepatitis B virus
cgtttctcctggctcagtttactagtgccatttgttcagtggttcgtag

SEQ ID NO: 2571 - DNA, 60 bp, Hepatitis B virus
ctaataaaaccaaacgttggggctactcccttaacttcatgggatatgtaattggaagtt

SEQ ID NO: 2572 - DNA, 53 bp, Hepatitis B virus
ctattgattggaaagtatgtcaaagaattgtgggtcttttgggctttgctgcc

SEQ ID NO: 2573 - DNA, 60 bp, Hepatitis B virus
gctttcactttctcgccaacttacaaggcctttctgtgtaaacaatatctaaacctttac

SEQ ID NO: 2574 - DNA, 48 bp, Hepatitis B virus
ctttctgtgtaaacaatatctaaacctttaccccgttgcccggcaacg

SEQ ID NO: 2575 - DNA, 45 bp, Hepatitis B virus
ttgcccggcaacggtcaggtctctgccaagtgtttgctgacgcaa

SEQ ID NO: 2576 - DNA, 49 bp, Hepatitis B virus
aaacttatcggaaccgacaactcagttgtcctctctcggaaatacacct

SEQ ID NO: 2577 - DNA, 45 bp, Hepatitis B virus
gaaatacacctcctttccatggctgctaggctgtgctgccaactg

SEQ ID NO: 2578 - DNA, 45 bp, Hepatitis B virus
gtgctgccaactggatcctgcgcgggacgtcctttgtctacgtcc

SEQ ID NO: 2579 - DNA, 45 bp, Hepatitis B virus
ctttgtctacgtcccgtcggcgctgaatcccgcggacgacccgtc

SEQ ID NO: 2580 - DNA, 45 bp, Hepatitis B virus
gtttgggcctctaccgtccccttcttcatctgccgttccggccga

SEQ ID NO: 2581 - DNA, 45 bp, Hepatitis B virus
atctgccggaccgtgtgcacttcgcttcacctctgcacgtagcat

SEQ ID NO: 2582 - DNA, 48 bp, Hepatitis B virus
caaggtcttacacaagaggactcttggactctcagcaatgtcaacgac

SEQ ID NO: 2583 - DNA, 51 bp, Hepatitis B virus
cagcaatgtcaacgaccgaccttgaggcatacttcaaagactgtttgttta

SEQ ID NO: 2584 - DNA, 49 bp, Hepatitis B virus
agcaccatgcaactttttcccctctgcctaatcatctcatgttcatgtc

SEQ ID NO: 2585 - DNA, 56 bp, Hepatitis B virus
agttactctcttttttgccttctgacttctttccttctattcgagatctcctcgac

SEQ ID NO: 2586 - DNA, 45 bp, Hepatitis B virus
cctctgctctgtatcgggaggccttagagtctccggaacattgtt

SEQ ID NO: 2587 - DNA, 45 bp, Hepatitis B virus
tgggtgggaagtaatttggaagacccagcatccagggaattagta

SEQ ID NO: 2588 - DNA, 57 bp, Hepatitis B virus
cacatttcctgccttacttttggaagagaaactgtccttgagtatttggtgtctttt

SEQ ID NO: 2589 - DNA, 46 bp, Hepatitis B virus
cgcttacagaccaccaaatgcccctatcttatcaacacttccggaa

SEQ ID NO: 2590 - DNA, 45 bp, Hepatitis B virus
ccctagaagaagaactccctcgcctcgcagacgaaggtctcaatc

SEQ ID NO: 2591 - DNA, 47 bp, Hepatitis B virus
gccgcgtcgcagaagatctcaatctcgggaatctcaatgttagtatc

SEQ ID NO: 2592 - DNA, 55 bp, Hepatitis B virus
aatctcgggaatctcaatgttagtatcccttggactcataaggtgggaaacttta

SEQ ID NO: 2593 - DNA, 56 bp, Hepatitis B virus
taatcctgattggaaaactccctcctttcctcacattcatttacaggaggacatta

SEQ ID NO: 2594 - DNA, 60 bp, Hepatitis B virus
agatgtcaacaatatgtgggccctctgacagttaatgaaaaaaggagattaaaattaatt

SEQ ID NO: 2595 - DNA, 60 bp, Hepatitis B virus
aattaattatgcctgctaggttctatcctaaccttaccaaatatttgcccttggacaaag

SEQ ID NO: 2596 - DNA, 60 bp, Hepatitis B virus
gcccttggacaaaggcattaaaccgtattatcctgaatatgcagttaatcattacttcaa

SEQ ID NO: 2597 - DNA, 60 bp, Hepatitis B virus
ttatcctgaatatgcagttaatcattacttcaaaactaggcattatttacatactctgtg

SEQ ID NO: 2598 - DNA, 60 bp, Hepatitis B virus
cattatttacatactctgtggaaggctggcattctatataagagagaaactacacgcagc

SEQ ID NO: 2599 - DNA, 47 bp, Hepatitis B virus
aatctttctgttcccaatcctctgggattctttcccgatcaccagtt

SEQ ID NO: 2600 - DNA, 47 bp, Hepatitis B virus
caactcaaacaatccagattgggacttcaaccccaacaaggatcact

SEQ ID NO: 2601 - DNA, 45 bp, Hepatitis B virus
acttcaaccccaacaaggatcactggccagaggcaaatcaggtag

SEQ ID NO: 2602 - DNA, 45 bp, Hepatitis B virus
aaatcaggtaggagcgggagcatttggtccagggttcaccccacc

SEQ ID NO: 2603 - DNA, 48 bp, Human parvovirus B19
ggacaattacgtcatttcctgtgacgtcatttcctgtgacgtcacttc

SEQ ID NO: 2604 - DNA, 45 bp, Human parvovirus B19
agagccaaccctaattccggaagtcccgcccaccggaagtgacgt

SEQ ID NO: 2605 - DNA, 57 bp, Human parvovirus B19
cttcaagtttcttctaatgttctggactgtgctaacgataactggtggtgctcttta

SEQ ID NO: 2606 - DNA, 60 bp, Human parvovirus B19
tgctctttactagatttagacacttctgactgggaaccactaactcatactaacagacta

SEQ ID NO: 2607 - DNA, 60 bp, Human parvovirus B19
tttttgccaggaatgactacaaaaggcaaatactttagagatggagagcagtttatagaa

SEQ ID NO: 2608 - DNA, 60 bp, Human parvovirus B19
tgtatggtgtgttactaatattgatggatatatagatacctgtatttctgctacttttag

SEQ ID NO: 2609 - DNA, 46 bp, Human parvovirus B19
gccataaatgatactagtagcgatgctggggagtctagcggcacag

SEQ ID NO: 2610 - DNA, 60 bp, Human parvovirus B19
ttgtgccatttaatgggaagggaactaaggctagcataaagtttcaaactatggtaaact

SEQ ID NO: 2611 - DNA, 60 bp, Human parvovirus B19
aagtttcaaactatggtaaactggttgtgtgaaaacagagtgtttacagaggataagtgg

SEQ ID NO: 2612 - DNA, 60 bp, Human parvovirus B19
agtcacagtggaagttttcaaattcaaagtgcactaaaactagcaatttataaagcaact

SEQ ID NO: 2613 - DNA, 60 bp, Human parvovirus B19
aaagcaactaatttagtgcctactagcacatttttattgcatacagactttgagcaggtt

SEQ ID NO: 2614 - DNA, 60 bp, Human parvovirus B19
tgtgttaaagtggattgataaaaaatgtggcaagaaaaatacactgtggttttatgggcc

SEQ ID NO: 2615 - DNA, 60 bp, Human parvovirus B19
caatggccattgctaaaagtgttccagtatatggcatggttaactggaataatgaaaact

SEQ ID NO: 2616 - DNA, 46 bp, Human parvovirus B19
aaaagccattttaggcgggcaacccaccagggtagatcaaaaaatg

SEQ ID NO: 2617 - DNA, 58 bp, Human parvovirus B19
ggttataaccagcaatggtgacattacttttgttgtaagcgggaacactacaacaact

SEQ ID NO: 2618 - DNA, 60 bp, Human parvovirus B19
taaagccttaaaagagcgcatggtaaagttaaactttactgtaagatgcagccctgacat

SEQ ID NO: 2619 - DNA, 56 bp, Human parvovirus B19
gaaaactgggcaataaactacacttttgatttccctggaattaatgcagatgccct

SEQ ID NO: 2620 - DNA, 45 bp, Human parvovirus B19
accagttcaggagaatcatttgtcggaagcccagtttcctccgaa

SEQ ID NO: 2621 - DNA, 49 bp, Human parvovirus B19
agtttcgtgaactgttagttggggttgattatgtgtgggacggtgtaag

SEQ ID NO: 2622 - DNA, 52 bp, Human parvovirus B19
gtaaggggtttacctgtgtgttgtgtgcaacatattaacaatagtgggggag

SEQ ID NO: 2623 - DNA, 53 bp, Human parvovirus B19
atattaacaatagtgggggaggcttgggactttgtccccattgcattaatgta

SEQ ID NO: 2624 - DNA, 56 bp, Human parvovirus B19
cttctaatcccttttctgtgctaacctgcaaaaaatgtgcttacctgtctggattg

SEQ ID NO: 2625 - DNA, 60 bp, Human parvovirus B19
acccatcctctctgtttgacttagttgctcgcattaaaaataaccttaaaaattctccag

SEQ ID NO: 2626 - DNA, 60 bp, Human parvovirus B19
aaattctccagacttatatagtcatcattttcaaagtcatggacagttatctgaccaccc

SEQ ID NO: 2627 - DNA, 48 bp, Human parvovirus B19
aaagtcatggacagttatctgaccacccccatgccttatcatccagta

SEQ ID NO: 2628 - DNA, 60 bp, Human parvovirus B19
tagcagtcatgcagaacctagaggagaagatgcagtattatctagtgaagacttacacaa

SEQ ID NO: 2629 - DNA, 60 bp, Human parvovirus B19
atgactttaggtatagccaactggctaagttgggaataaatccatatactcattggactg

SEQ ID NO: 2630 - DNA, 46 bp, Human parvovirus B19
aaggaagtttgccggaagttcccgcttacaacgcctcagaaaaata

SEQ ID NO: 2631 - DNA, 55 bp, Human parvovirus B19
cttacaacgcctcagaaaaatacccaagcatgacttcagttaattctgcagaagc

SEQ ID NO: 2632 - DNA, 60 bp, Human parvovirus B19
ttttctagacagtttttaattccatatgacccagagcaccattataaggtgttttctccc

SEQ ID NO: 2633 - DNA, 60 bp, Human parvovirus B19
gtttgcaccattagtcccataatgggatactcaaccccatggagatatttagattttaat

SEQ ID NO: 2634 - DNA, 60 bp, Human parvovirus B19
tgatgctttaactgtaaccatatcagaaattgctgttaaggatgttacagacaaaactgg

SEQ ID NO: 2635 - DNA, 56 bp, Human parvovirus B19
gtcaagatactttagccccagaacttcctatttgggtatactttccccctcaatat

SEQ ID NO: 2636 - DNA, 60 bp, Human parvovirus B19
tcctatttgggtatactttccccctcaatatgcttacttaacagtaggagatgttaacac

SEQ ID NO: 2637 - DNA, 60 bp, Human parvovirus B19
taacagtaggagatgttaacacacaaggaatttctggagacagcaaaaaattagcaagtg

SEQ ID NO: 2638 - DNA, 47 bp, Human parvovirus B19
cttataagtttcctccagtgcccccagaaaatttagagggctgcagt

SEQ ID NO: 2639 - DNA, 60 bp, Human parvovirus B19
gacacattaggaggtgacccaaaatttagatctttaacacatgaagaccatgcaattcag

SEQ ID NO: 2640 - DNA, 60 bp, Human parvovirus B19
aaatatgtcacaggaataaatgctatttctcatggtcagaccacttatggtaacgctgaa

SEQ ID NO: 2641 - DNA, 60 bp, Human parvovirus B19
ttaaacatgcacacctactttcccaataaaggaacccagcaatatacagatcaaattgag

SEQ ID NO: 2642 - DNA, 60 bp, Human parvovirus B19
gtaaaattccaaatttagatgacagttttaaaactcagtttgcagccttaggaggatggg

SEQ ID NO: 2643 - DNA, 60 bp, Human parvovirus B19
gggaattactaccttagttcagtatgccgtgggaattatgacagtaaccatgacatttaa

SEQ ID NO: 2644 - DNA, 45 bp, Human parvovirus B19
caacctggagtatatcccccgcacgcagcaggtcatttaccatat

SEQ ID NO: 2645 - DNA, 46 bp, Human parvovirus B19
atatgaaaagcctgaagaattgtggacagccaaaagccgtgtgcac

SEQ ID NO: 2646 - DNA, 60 bp, Human parvovirus B19
tgtagaatttaagtatttaaccagatatgaacaacatgttattagaatgttaagattgtg

SEQ ID NO: 2647 - DNA, 48 bp, Human parvovirus B19
ggaagtgacgtcacaggaaatgacgtcacaggaaatgacgtaattgtc

SEQ ID NO: 2648 - DNA, 54 bp, Treponema pallidum
ctctcagacattcaaagttttggtgcggggaaggtagattgcgtaattcaaaat

SEQ ID NO: 2649 - DNA, 53 bp, Treponema pallidum
ggtcaaatattcagcctggtgagattacgtataatgacgcatacacgctcctc

SEQ ID NO: 2650 - DNA, 51 bp, Treponema pallidum
gagattacgtataatgacgcatacacgctcctcccctttagtaacacgctg

SEQ ID NO: 2651 - DNA, 56 bp, Treponema pallidum
gcagagttgaaacaaattatagaggatgcattgcagtttgcacttggtgatggttc

SEQ ID NO: 2652 - DNA, 60 bp, Treponema pallidum
atgcggagtctttgattaagtttttgcgtgcgcataaaaattttcgtgcatacacagatt

SEQ ID NO: 2653 - DNA, 60 bp, Treponema pallidum
gcgtgcgcataaaaattttcgtgcatacacagattccaatgtgatattccgtcttaaata

SEQ ID NO: 2654 - DNA, 60 bp, Treponema pallidum
acacagattccaatgtgatattccgtcttaaatagtaggaagtaacttacattagaggcc

SEQ ID NO: 2655 - DNA, 50 bp, Treponema pallidum
taaagaactacgttctttacaggctgtgccaatctgcttttccgggaaag

SEQ ID NO: 2656 - DNA, 45 bp, Treponema pallidum
caatctgcttttccgggaaagacaaagggtatgccacgttaggag

SEQ ID NO: 2657 - DNA, 53 bp, Treponema pallidum
ctgcacataaccttatctttgcgattgaccgtggtatactccttgcaccttat

SEQ ID NO: 2658 - DNA, 51 bp, Treponema pallidum
caaattccccttatcgaagaaatcctgtgtgcactgggcattacagttttg

SEQ ID NO: 2659 - DNA, 53 bp, Treponema pallidum
aaaacgagttgcggctgagcactgtcatgttgtgattatctcctcagataaag

SEQ ID NO: 2660 - DNA, 53 bp, Treponema pallidum
gtgatacggtgcaagtgctcagacttgacatagatcataagtggacatgttgc

SEQ ID NO: 2661 - DNA, 53 bp, Treponema pallidum
caacacaattacttgatttgttctctctcatgggagattcctccgacaatgtg

SEQ ID NO: 2662 - DNA, 45 bp, Treponema pallidum
ttctctctcatgggagattcctccgacaatgtgcctggtgtgaga

SEQ ID NO: 2663 - DNA, 52 bp, Treponema pallidum
taagacggctgcacatcttctccactgttttggcacacttgatggtatttat

SEQ ID NO: 2664 - DNA, 59 bp, Treponema pallidum
cactgttttggcacacttgatggtatttatcgtcatacctattccttaaaagaagcgct

SEQ ID NO: 2665 - DNA, 49 bp, Treponema pallidum
ctcgatgtaacgtctgctgcacgtatttttgtgcgagaaggattgcatg

SEQ ID NO: 2666 - DNA, 52 bp, Treponema pallidum
gtatttttgtgcgagaaggattgcatgcgcttgcacaacaatatcgtgcttg

SEQ ID NO: 2667 - DNA, 60 bp, Treponema pallidum
tgcacaacaatatcgtgcttgtgtgcaagaaatagatacagaagcaacaaacgatacatt

SEQ ID NO: 2668 - DNA, 60 bp, Treponema pallidum
tgcaagaaatagatacagaagcaacaaacgatacattacaaatgacagagtcttctgtgc

SEQ ID NO: 2669 - DNA, 54 bp, Treponema pallidum
atacattacaaatgacagagtcttctgtgctcacgtctggtcgatgtgcaaatg

SEQ ID NO: 2670 - DNA, 55 bp, Treponema pallidum
cgccatacctatagaaaatagagatcttaggcaggatgttatgcttgcacgcagt

SEQ ID NO: 2671 - DNA, 60 bp, Treponema pallidum
cagtgcaggtcattatcgtggtgttactgaccctgtagaacttaaacgtattattgattg

SEQ ID NO: 2672 - DNA, 54 bp, Treponema pallidum
gttactgaccctgtagaacttaaacgtattattgattgcgcgtgtgcgaatggt

SEQ ID NO: 2673 - DNA, 46 bp, Treponema pallidum
gtttgattgtgaaacggatggattgcatccgcacgatacacgtctg

SEQ ID NO: 2674 - DNA, 50 bp, Treponema pallidum
gtctggtcggattttcgatctgctttcaggaagcagaggctttttatgtt

SEQ ID NO: 2675 - DNA, 49 bp, Treponema pallidum
atgtgcacgtagcactaatgtcgagactgaaaaggagtgcacagaacag

SEQ ID NO: 2676 - DNA, 60 bp, Treponema pallidum
cttgttatgcataatggaaagtttgattatcacgttatgcatcgtgcaggcgtttttgag

SEQ ID NO: 2677 - DNA, 48 bp, Treponema pallidum
attacatttgaagaagtggtagcaaaagggcaaacctttgcgcacgtc

SEQ ID NO: 2678 - DNA, 60 bp, Treponema pallidum
gcggaggatgcagatattacttttcgtttataccattatttaaaactccgcttggaaaca

SEQ ID NO: 2679 - DNA, 51 bp, Treponema pallidum
gaaacagcaggattgctttctgtgtttgagaccatagaaatgccgcttttg

SEQ ID NO: 2680 - DNA, 60 bp, Treponema pallidum
cagacagtcctttttcaagaattacatttaccgcccggtaaaaagaatactcaaggttat

SEQ ID NO: 2681 - DNA, 60 bp, Treponema pallidum
accgcccggtaaaaagaatactcaaggttattctactgatcattctgtattgaagaaact

SEQ ID NO: 2682 - DNA, 60 bp, Treponema pallidum
aagcatcccattgcagaaaaaatattgctctttagagatctttcaaagttacgttcgacg

SEQ ID NO: 2683 - DNA, 60 bp, Treponema pallidum
ttggcccatctatctcaagatagaaatcttctcaatgcatttcgacagcacattgatatt

SEQ ID NO: 2684 - DNA, 60 bp, Treponema pallidum
tctcaatgcatttcgacagcacattgatattcatgcattgactgctgcatatattttcaa

SEQ ID NO: 2685 - DNA, 60 bp, Treponema pallidum
gcaaaaactattaactttggaatcgtgtatggaatgagcgcttttagattgagtgacgaa

SEQ ID NO: 2686 - DNA, 60 bp, Treponema pallidum
atcgtgtatggaatgagcgcttttagattgagtgacgaacttaaaatttctcagaaggaa

SEQ ID NO: 2687 - DNA, 60 bp, Treponema pallidum
gttgaatactcaaattcagagttctgcggcggatattgtgaaaattgccatgatagcaat

SEQ ID NO: 2688 - DNA, 55 bp, Treponema pallidum
gtatacacgtggagtctggaaatagttggggtgattttcattagcatacccatct

SEQ ID NO: 2689 - DNA, 45 bp, Treponema pallidum
acgcttcaaaagccaaacacgcttaagacacacgggataggacac

SEQ ID NO: 2690 - DNA, 49 bp, Treponema pallidum
ctgaacctttaaaccgatcgaacccatagttgataccacacgaaatgcg

SEQ ID NO: 2691 - DNA, 51 bp, Treponema pallidum
gtagtagtcgtagcggaccgtgttgaagttcatcacatagtcgatgaactc

SEQ ID NO: 2692 - DNA, 54 bp, Treponema pallidum
cttacgtgcagaaaaactatcctcagtgagcattgtcttaaggccgttggtatt

SEQ ID NO: 2693 - DNA, 45 bp, Treponema pallidum
gttggtattctccgtaacgcgggagtcttccacgaagtgaaactt

SEQ ID NO: 2694 - DNA, 53 bp, Treponema pallidum
tcttccacgaagtgaaacttctcctttgcaatcccttttaattcatgaggaac

SEQ ID NO: 2695 - DNA, 55 bp, Treponema pallidum
caactgggacaaacttcataccgtgaacctttacgttcgtaatcttgtattcctc

SEQ ID NO: 2696 - DNA, 45 bp, Treponema pallidum
cttcggtctcctgcttcgagagaaccttttcgcccaatacctcaa

SEQ ID NO: 2697 - DNA, 48 bp, Treponema pallidum
atgataatcctcctccttcaattctgacttcggccttttccacaacgc

SEQ ID NO: 2698 - DNA, 60 bp, Treponema pallidum
atgcagatagatgggaaacgcgatatgatcagaatacttcttaattacctcttcaagacg

SEQ ID NO: 2699 - DNA, 54 bp, Treponema pallidum
aatacttcttaattacctcttcaagacgccagcgcgttgcaaactcggaatttt

SEQ ID NO: 2700 - DNA, 46 bp, Treponema pallidum
atcaacctcatccaaggtataggcattttgcccttcagacgtccac

SEQ ID NO: 2701 - DNA, 53 bp, Treponema pallidum
agagtaaaaccctacgccaaactggcctatcagattggaatcctgtttttgat

SEQ ID NO: 2702 - DNA, 51 bp, Treponema pallidum
gtatcacgcacaacaagccgttgagcatcttcttcaaacgcgatgtctata

SEQ ID NO: 2703 - DNA, 60 bp, Treponema pallidum
atcaacaagtgcctcatacttcaacttatctaacgcatccgacgcattagagataagttc

SEQ ID NO: 2704 - DNA, 52 bp, Treponema pallidum
gaaccgttagtttctttaacatgcgcgataggtccggaatagtgcaggttat

SEQ ID NO: 2705 - DNA, 55 bp, Treponema pallidum
gttgatgatgttgtgcatgcgcacgaagatatacgcttaaaatatcgctacctcg

SEQ ID NO: 2706 - DNA, 56 bp, Treponema pallidum
atacggcagtttttaagtatgaaaggtttcatcgagatcgaaactcccaccttcat

SEQ ID NO: 2707 - DNA, 45 bp, Treponema pallidum
tttgaccgctatttccaacttgcccgttgctaccgagacgaggat

SEQ ID NO: 2708 - DNA, 45 bp, Treponema pallidum
gttgctacagccgtaggcaaatcgaagcgttggagtctatcgctc

SEQ ID NO: 2709 - DNA, 46 bp, Treponema pallidum
gactttctgctcaggatgaagacttgttgctctttgtcgccgattg

SEQ ID NO: 2710 - DNA, 53 bp, Treponema pallidum
agagaaggagttgttttctttcgtgtggatcgttgattttcccctctttgaat

SEQ ID NO: 2711 - DNA, 47 bp, Treponema pallidum
atcgttgattttcccctctttgaatggaacccagcggaaaacaagtg

SEQ ID NO: 2712 - DNA, 46 bp, Treponema pallidum
cctgctcatcacatgttctctgctcctcaggaacagtatcttgaga

SEQ ID NO: 2713 - DNA, 47 bp, Treponema pallidum
aagatcccggttcggtaaaaggtgacctctatgatttggtgctcaac

SEQ ID NO: 2714 - DNA, 50 bp, Treponema pallidum
atctttaagatagtgggattagatcctgaagaagcgggggaaaagttcgg

SEQ ID NO: 2715 - DNA, 54 bp, Treponema pallidum
gacaggaagcgagtcaattagagacgtcattgcttttcctaaaaatacactcgc

SEQ ID NO: 2716 - DNA, 48 bp, Treponema pallidum
ctctattcagaaggcatttacgcgtaacctggtctcaacgctcatctc

SEQ ID NO: 2717 - DNA, 51 bp, Treponema pallidum
ctagcaatcgtcgcaaacttctacgcagtagaacgcttaacattggcagac

SEQ ID NO: 2718 - DNA, 49 bp, Treponema pallidum
agtggcagtagcaggtgcacagttttttctcactgttgcgtatcgatac

SEQ ID NO: 2719 - DNA, 59 bp, Treponema pallidum
gttttttctcactgttgcgtatcgatacgcgccaaaaaagtcgattccaattgactata

SEQ ID NO: 2720 - DNA, 56 bp, Treponema pallidum
acatctggtctactgcgtttaccttgctgtttattatcgatccgattgggaacata

SEQ ID NO: 2721 - DNA, 53 bp, Treponema pallidum
gaagcgtcattctctttctcgttggcatcaagatggtatttcctgatcaacac

SEQ ID NO: 2722 - DNA, 51 bp, Treponema pallidum
cgaatcacaggtatcttgctgctcattctttccatccagatgtgtgttgag

SEQ ID NO: 2723 - DNA, 46 bp, Treponema pallidum
ctctgggtgtcaaaggaagaagtgccatctttgacgaaggcataga

SEQ ID NO: 2724 - DNA, 49 bp, Treponema pallidum
tatgctgggtttgatacgattcgtgagacggcacatcgaggtaagaaat

SEQ ID NO: 2725 - DNA, 51 bp, Treponema pallidum
gtaacttaaacgcgaacacccttcaggaataggcgcgatatggaaaagaac

SEQ ID NO: 2726 - DNA, 48 bp, Treponema pallidum
ttcaggaataggcgcgatatggaaaagaacggagcgttcagtgagatt

SEQ ID NO: 2727 - DNA, 51 bp, Treponema pallidum
cgagaatcaacaacactttgacgcattgctcgcctctcttgatcttgattc

SEQ ID NO: 2728 - DNA, 46 bp, Treponema pallidum
ctcgcaagaggaacctgtatcctatgacttccctgcgtttgatctg

SEQ ID NO: 2729 - DNA, 49 bp, Treponema pallidum
gattcttctaactctgctctcactgagattgaaatcaccccagcgctct

SEQ ID NO: 2730 - DNA, 46 bp, Treponema pallidum
gataacttggtcgcccaattccccattgaagaaagcgtgcagatac

SEQ ID NO: 2731 - DNA, 45 bp, Treponema pallidum
gatacctcctttccccgctgatggctttgaacttcccggtaaatt

SEQ ID NO: 2732 - DNA, 54 bp, Treponema pallidum
gtaaattccaagaatttgcgagagaatctgagagcccctatttcagtcctgata

SEQ ID NO: 2733 - DNA, 48 bp, Treponema pallidum
gcagaccaagcacagaccataagcgaaacggaatatcaacgctttctc

SEQ ID NO: 2734 - DNA, 46 bp, Treponema pallidum
ctcggacaaagagggttatgcgctcattagcagcattgcaaacaac

SEQ ID NO: 2735 - DNA, 47 bp, Treponema pallidum
cctcgccaaaagcggttgctactcaactcgagcacattctaaaaaag

SEQ ID NO: 2736 - DNA, 51 bp, Treponema pallidum
catgcattagaactggaccgctacgaagatgcacacactaactttgaacac

SEQ ID NO: 2737 - DNA, 60 bp, Treponema pallidum
gacaaaaaacaatatacacgtgctgaacaaatttacaccgagttactctttgatttccgg

SEQ ID NO: 2738 - DNA, 53 bp, Treponema pallidum
atcatccaaatgatcctgatatcctcagcgcactcggagacgtatatctagag

SEQ ID NO: 2739 - DNA, 49 bp, Treponema pallidum
ctgctcaatacgagcaggctcgaaaaacataccaatcactcatcgcttc

SEQ ID NO: 2740 - DNA, 60 bp, Treponema pallidum
ctcctgaagatttgacagaactcagtggataccttttagagaaacgctatgaatctcaac

SEQ ID NO: 2741 - DNA, 50 bp, Treponema pallidum
aatctcaacccagtgactcccttacattgcagtcaaagattgaggatctg

SEQ ID NO: 2742 - DNA, 51 bp, Treponema pallidum
ggatcctatgtctgcggatgcggcttattaccttggaaaattctttgtcta

SEQ ID NO: 2743 - DNA, 60 bp, Treponema pallidum
tgactatgcagatatggactactttatctacaaaaactatgactctgcgttggagcacta

SEQ ID NO: 2744 - DNA, 55 bp, Treponema pallidum
gcgggcgcagttacttgatactcctgaggttcaatacaaaatagggtatattcag

SEQ ID NO: 2745 - DNA, 53 bp, Treponema pallidum
ataagcaccttttatatggattcggcaccctgttgtgtaaacgtggtgactac

SEQ ID NO: 2746 - DNA, 47 bp, Treponema pallidum
gaaaaatgcacgggcgttaactctgtttgcagaatcctctcgtgcat

SEQ ID NO: 2747 - DNA, 49 bp, Treponema pallidum
gatttcccactaccaactttcctggcggataacgtaatcgtgaaacctt

SEQ ID NO: 2748 - DNA, 49 bp, Treponema pallidum
gaacaccaaaggaatcttgaggtaagacaccaggagaagtctgcctatc

SEQ ID NO: 2749 - DNA, 46 bp, Treponema pallidum
ctctatttgcagcgtaaggtccccgatcattgatgcgcacgattac

SEQ ID NO: 2750 - DNA, 49 bp, Treponema pallidum
cacttgcggtaggtcttccgttaaaagactccgcatagtaggaagcata

SEQ ID NO: 2751 - DNA, 54 bp, Treponema pallidum
gcttatcggaatatggacaaaaaggttgaaatcttttaaggtaggggcgcagtg

SEQ ID NO: 2752 - DNA, 60 bp, Ehrlichia chaffeensis
atcacaaatatgataagaatattatctttaccaacttctataaagtctatgataaacgat

SEQ ID NO: 2753 - DNA, 60 bp, Ehrlichia chaffeensis
tgtttgtctaattcaagtagagaattatgttctaatatccttattactattaaatcaaca

SEQ ID NO: 2754 - DNA, 60 bp, Ehrlichia chaffeensis
ctgagattgaaagattagatagtaaaaaattaactacatttaataggttaaaattttcgt

SEQ ID NO: 2755 - DNA, 60 bp, Ehrlichia chaffeensis
acttctgaatcttatattcttaccatattaagatgatattgcaatataaaaattgctatg

SEQ ID NO: 2756 - DNA, 60 bp, Ehrlichia chaffeensis
gtcaagtgatgatttaatcttttagttaatgaatacactttcttatttactttcattatt

SEQ ID NO: 2757 - DNA, 60 bp, Ehrlichia chaffeensis
tcactcataattctgaacttgtttataaactctaagaaatatatagtaacattatgaaaa

SEQ ID NO: 2758 - DNA, 60 bp, Ehrlichia chaffeensis
aaaagttttatattgatttaagttataagtaagtatcttttgtttagtaaaaatacctta

SEQ ID NO: 2759 - DNA, 60 bp, Ehrlichia chaffeensis
tcttttgtttagtaaaaataccttatattgaacatatattcaaaagtaattcacttgtaa

SEQ ID NO: 2760 - DNA, 60 bp, Ehrlichia chaffeensis
ggagacaatttttattatctactatttctaaagtaacttataacattaaagtcaatggaa

SEQ ID NO: 2761 - DNA, 60 bp, Ehrlichia chaffeensis
actttctcttattctataatggtaagtatattagaaattaatatcaaaaagttgaaacat

SEQ ID NO: 2762 - DNA, 60 bp, Ehrlichia chaffeensis
gaattccacgataaaaaatacatagttatgaaagaaagtgatatcattgcaaaagaagca

SEQ ID NO: 2763 - DNA, 60 bp, Ehrlichia chaffeensis
tgtgactggtgaacaacttgataaatcaattagagaagttgttcgtattttagaagatgc

SEQ ID NO: 2764 - DNA, 60 bp, Ehrlichia chaffeensis
gagtataaagccagaggatccattggctcttgctattgctaatataattactcagagtgc

SEQ ID NO: 2765 - DNA, 60 bp, Ehrlichia chaffeensis
tgctaatataattactcagagtgcttctcaatgtaatgataaagttggtgatggaacaac

SEQ ID NO: 2766 - DNA, 60 bp, Ehrlichia chaffeensis
gaggctgttttggaagcattaatgtctatgaagcgtgaagtgttgtctgaagaagaaatt

SEQ ID NO: 2767 - DNA, 60 bp, Ehrlichia chaffeensis
actgatggtatgcagtttgatcgtggatacctttctccttattttgtaactaattcagaa

SEQ ID NO: 2768 - DNA, 60 bp, Ehrlichia chaffeensis
acctttctccttattttgtaactaattcagaaaagatgttagtggaatttgaaaatcctt

SEQ ID NO: 2769 - DNA, 60 bp, Ehrlichia chaffeensis
gtggaatttgaaaatccttatatcttactaacagagaaaaaacttaatatcatacaacct

SEQ ID NO: 2770 - DNA, 60 bp, Ehrlichia chaffeensis
acagagaaaaaacttaatatcatacaacctatattaccaattttggaaaatgtggctaga

SEQ ID NO: 2771 - DNA, 60 bp, Ehrlichia chaffeensis
cctcttttaattattgcagaagatgtggaaggtgaagcacttagcactctcgttttaaat

SEQ ID NO: 2772 - DNA, 49 bp, Ehrlichia chaffeensis
ggttacatgtagcagcagttaaagcgccagggtttggtgatagaagaaa

SEQ ID NO: 2773 - DNA, 60 bp, Ehrlichia chaffeensis
tacgtattacaaaagatactactactattatcggtagtgtagataatagttctgctaatg

SEQ ID NO: 2774 - DNA, 60 bp, Ehrlichia chaffeensis
tagtgaagttgaagttaaagaacgtaaagaccgtgttgaagatgctttacacgcaactag

SEQ ID NO: 2775 - DNA, 60 bp, Ehrlichia chaffeensis
aggtggtgctgcattattatatacattatcagttcttgaaaacttgaagagtaaaaatga

SEQ ID NO: 2776 - DNA, 60 bp, Ehrlichia chaffeensis
cactgaaggtagtgcgtatagcatttgattttgctgtatctcttgcagcagtatttatga

SEQ ID NO: 2777 - DNA, 55 bp, Ehrlichia chaffeensis
aggcatgggaggcatgggaggtatgggaggattctaattaatagataatcttcta

SEQ ID NO: 2778 - DNA, 60 bp, Ehrlichia chaffeensis
aaaacgtattttaagattagaacgtaaaatattaaaacctaaagaagaagtataagattt

SEQ ID NO: 2779 - DNA, 60 bp, Ehrlichia chaffeensis
aaccacattctaataagtctatatttagtttggttataacttattgatttataatcttaa

SEQ ID NO: 2780 - DNA, 60 bp, Ehrlichia chaffeensis
tggtcttgtatactaaaatgtgtagaaattttcctaataacaaaaactatgtaattcatt

SEQ ID NO: 2781 - DNA, 60 bp, Ehrlichia chaffeensis
ctatattatatctgatctttatgttaataatccacaattttatataagaagagtttgatt

SEQ ID NO: 2782 - DNA, 60 bp, Ehrlichia chaffeensis
caagttgataacaataaacctgaaatttataaaagactgaatttagacataaaaatgtct

SEQ ID NO: 2783 - DNA, 60 bp, Ehrlichia chaffeensis
aatgatcaatagtaatgaatatacttaaatttctgctttataatctgttttataacatga

SEQ ID NO: 2784 - DNA, 60 bp, Ehrlichia chaffeensis
ccactatgatattagtattaatgataaattgattatattaatcaatgataatatccctca

SEQ ID NO: 2785 - DNA, 60 bp, Ehrlichia chaffeensis
ggagttaaaaattttgttataatatcttctgatactatcatatcgttaaaaaacttacca

SEQ ID NO: 2786 - DNA, 60 bp, Ehrlichia chaffeensis
tgaaatgtaaatttattctcaatgttgacttaatttaaaagagtaacaatgttattgaca

SEQ ID NO: 2787 - DNA, 60 bp, Ehrlichia chaffeensis
tagtttagtatacttatttatcaattcagaataatacttaccttatattaattgactatc

SEQ ID NO: 2788 - DNA, 60 bp, Ehrlichia chaffeensis
tgtatcaattatcgaaaattatgttaatgtttattacaaacaatagtaaaaaaggtaatc

SEQ ID NO: 2789 - DNA, 60 bp, Ehrlichia chaffeensis
ttactataaatttagtgtgatataatggataaatttaaataccattacttctacagtagt

SEQ ID NO: 2790 - DNA, 60 bp, Ehrlichia chaffeensis
atcgtatttaatgtctatattaccttataacttcattaaggtatttctagataataatgt

SEQ ID NO: 2791 - DNA, 60 bp, Ehrlichia chaffeensis
agtttattcttaatagaacattcatttttgataaattcttgctatagatgtatactagaa

SEQ ID NO: 2792 - DNA, 60 bp, Ehrlichia chaffeensis
tcatatccaatagagtcaaaaagtttattcttaatagaatcatttttgataaattcttgt

SEQ ID NO: 2793 - DNA, 60 bp, Ehrlichia chaffeensis
gatcactattacatgattgaaattacaatttaatgtgtaaatcaacattatatgataata

SEQ ID NO: 2794 - DNA, 60 bp, Ehrlichia chaffeensis
tttgttatcttactaatattcatacattgatgtaaaaccttagataaactatttcctgaa

SEQ ID NO: 2795 - DNA, 60 bp, Ehrlichia chaffeensis
acgatataccagtaaatttaggttataaaaacttaattctaactacattctataatcaaa

SEQ ID NO: 2796 - DNA, 60 bp, Ehrlichia chaffeensis
acaataagtcaatataacatcaataatgcgatataaaattactatagaatataatggatc

SEQ ID NO: 2797 - DNA, 60 bp, Ehrlichia chaffeensis
agaaagtataatatcagatttattaaatcaaactttaagtattgtaatttcaacaatcaa

SEQ ID NO: 2798 - DNA, 60 bp, Ehrlichia chaffeensis
aaatcaaactttaagtattgtaatttcaacaatcaatagtatagaactgaattttagcaa

SEQ ID NO: 2799 - DNA, 60 bp, Ehrlichia chaffeensis
tcttataatcatgaatcatattagtaagataaatcctaaaaaagaattaagccaatgttt

SEQ ID NO: 2800 - DNA, 60 bp, Ehrlichia chaffeensis
tcgtcaacccatattacagatcaaatagttaactatgctggcaatatcagtgattactca

SEQ ID NO: 2801 - DNA, 60 bp, Ehrlichia chaffeensis
acgtgatattattgaacctccagtaaaagtaatagcaaacctaccctatcatatagcaac

SEQ ID NO: 2802 - DNA, 60 bp, Ehrlichia chaffeensis
cactatctatactcattcaattactatctaatgtgtataaaatggaggattttggaccag

SEQ ID NO: 2803 - DNA, 60 bp, Ehrlichia chaffeensis
ttcacctcaacccaaagtaatgtcatctgtaattaacattattgcattaccagaacccag

SEQ ID NO: 2804 - DNA, 60 bp, Ehrlichia chaffeensis
aacattattgcattaccagaacccagatttcatgtaaattatagaaagttatctcaagta

SEQ ID NO: 2805 - DNA, 60 bp, Ehrlichia chaffeensis
acgtcctgaaaacttatcaatagaacaattctgtcaaattacaaattgtataaactaaat

SEQ ID NO: 2806 - DNA, 60 bp, Ehrlichia chaffeensis
aactaaggaaatattcaattcagttataaaattacttcaatcaaataacaatttaactaa

SEQ ID NO: 2807 - DNA, 60 bp, Ehrlichia chaffeensis
gacatattatcaataagataaataactttcttaagaattagatttaatatatacttacgt

SEQ ID NO: 2808 - DNA, 60 bp, Ehrlichia chaffeensis
acttatatcagacttaattttcttacgtttacaatttaataggtctagtaattctttttc

SEQ ID NO: 2809 - DNA, 60 bp, Ehrlichia chaffeensis
ccaactaattttaaataggatgtatattatagaattcattacttaattagtgtaacacat

SEQ ID NO: 2810 - DNA, 60 bp, Ehrlichia chaffeensis
ccaactaattttaaaggatgtaatagaattcattacttaattagtgtaatacattacata

SEQ ID NO: 2811 - DNA, 60 bp, Ehrlichia chaffeensis
tagattaacaaatttatagtagtattacttaatataaaatcactaatttatataccagca

SEQ ID NO: 2812 - DNA, 60 bp, Ehrlichia chaffeensis
ttcaacactaaatttacagtaactatattcaaatatacctataattatcttataattaca

SEQ ID NO: 2813 - DNA, 60 bp, Ehrlichia chaffeensis
acctataattatcttataattacattaattaccaataacatgttaagtataaaacaaaga

SEQ ID NO: 2814 - DNA, 60 bp, Ehrlichia chaffeensis
atgtccatatatacaataatacttaaaataactcatacagaatatctcttgtaataattt

SEQ ID NO: 2815 - DNA, 60 bp, Ehrlichia chaffeensis
ggtatcactgaagataataaagaagtattcttaacactaataatgatattacaaaaaata

SEQ ID NO: 2816 - DNA, 60 bp, Ehrlichia chaffeensis
catctacactatattctctatcttgtaataccataaaattagatgtagacattcttttga

SEQ ID NO: 2817 - DNA, 60 bp, Ehrlichia chaffeensis
aaagcatattacttcttataataaatagagccataatttattatacaatcatagaaggtt

SEQ ID NO: 2818 - DNA, 60 bp, Ehrlichia chaffeensis
tgagtaagatatgaataagtagtagttagataaaactttaaacagaacataaaatacact

SEQ ID NO: 2819 - DNA, 60 bp, Ehrlichia chaffeensis
aactaataagtcactattcttatattgatattaacaattttattacttataatgagcaaa

SEQ ID NO: 2820 - DNA, 60 bp, Ehrlichia chaffeensis
tgttgttcttctaaattacttatttctacacagaaaaatatacttatattattccatcaa

SEQ ID NO: 2821 - DNA, 60 bp, Ehrlichia chaffeensis
cttagatatttacttctatgactaatatcaaacattatcttttgaatttgaaataacaca

SEQ ID NO: 2822 - DNA, 60 bp, Ehrlichia chaffeensis
tttcaactagataaaaaatcagtaatgctaaatttgatcaataccataattaatttacta

SEQ ID NO: 2823 - DNA, 60 bp, Ehrlichia chaffeensis
agttttcataattatcatctattttagataattcataatgataattcaccataataccca

SEQ ID NO: 2824 - DNA, 60 bp, Ehrlichia chaffeensis
tcatcttgtaaatacttaattaagttgcctatatataaacttctatgctctaatatatct

SEQ ID NO: 2825 - DNA, 60 bp, Ehrlichia chaffeensis
actaatattttcaataacttaaagcattaataagggaaattatttattagattaaactct

SEQ ID NO: 2826 - DNA, 60 bp, Ehrlichia chaffeensis
acagtatattataaaaaacagatatccatctaacatttagatttactaattgtgaagaca

SEQ ID NO: 2827 - DNA, 60 bp, Ehrlichia chaffeensis
caagattcagtatctaataagttttaagattactttaacctgatacaaaatacttaatca

SEQ ID NO: 2828 - DNA, 60 bp, Ehrlichia chaffeensis
tcaatactattaaaacagtaaaaaggtattaatgactatattaaaatacctgagtaaaca

SEQ ID NO: 2829 - DNA, 60 bp, Ehrlichia chaffeensis
acattatcttcagtaatgaatactttattcacatataattttactgaacatttcctatca

SEQ ID NO: 2830 - DNA, 60 bp, Ehrlichia chaffeensis
tcatttaatatatacacgataatacattcattaattgttaaagaattacatctatactac

SEQ ID NO: 2831 - DNA, 60 bp, Ehrlichia chaffeensis
acttttttacacaatacaagttttctactacataattataattgaatttacatttgctat

SEQ ID NO: 2832 - DNA, 60 bp, Ehrlichia chaffeensis
ttgatttaatattctctacaatactataacatcctactttatcttgatatacaagaaact

SEQ ID NO: 2833 - DNA, 60 bp, Ehrlichia chaffeensis
aaactttccaaaatttatctcataagtatttctagtatctatagtataaacatcagatct

SEQ ID NO: 2834 - DNA, 60 bp, Ehrlichia chaffeensis
ttctcaactctatcattgtatgatatcactacttatcatttaacttataagttacttatt

SEQ ID NO: 2835 - DNA, 60 bp, Ehrlichia chaffeensis
caatcatcagtttctgataacttataatgatttttatcattaaacaaactaaattggtta

SEQ ID NO: 2836 - DNA, 60 bp, Ehrlichia chaffeensis
aaacctatcaatatattctctttctgtattatctaacataattctaaaaaggtttactct

SEQ ID NO: 2837 - DNA, 60 bp, Ehrlichia chaffeensis
tcctagataatctagatctcttttgatttaacatatgatttagaatcaatactttaacca

SEQ ID NO: 2838 - DNA, 60 bp, Ehrlichia chaffeensis
ggttctctatataaattatcaacctttaatttaataagttcttgatttaatatttcatcc

SEQ ID NO: 2839 - DNA, 60 bp, Ehrlichia chaffeensis
ttcgcatctatattcttaaaatcaaataacaacaaactagtttttatattactagaagtt

SEQ ID NO: 2840 - DNA, 60 bp, Ehrlichia chaffeensis
tttcgcttatacattcattataaagttcttattttctatacccatattaactattcatca

SEQ ID NO: 2841 - DNA, 60 bp, Ehrlichia chaffeensis
agttcttattttctatacccatattaactattcatcatatcaaagaattcattattgtct

SEQ ID NO: 2842 - DNA, 60 bp, Ehrlichia chaffeensis
ctactaacagaatttaatataacaaattctatattctcataggcataataatgtaagtga

SEQ ID NO: 2843 - DNA, 60 bp, Ehrlichia chaffeensis
actcaagtaataattgaattattcattaatagagaataccaaatcataaaattactagtg

SEQ ID NO: 2844 - DNA, 60 bp, Ehrlichia chaffeensis
acctaaataactaaacatatcaatagaaagtttagtatataccattaaatctttaagtta

SEQ ID NO: 2845 - DNA, 60 bp, Ehrlichia chaffeensis
gcataactaaaattaatgataattaacaacatcattatcattactctaaatttataagca

SEQ ID NO: 2846 - DNA, 60 bp, Ehrlichia chaffeensis
acaatttcataatcataaatatttgcataagaatataacaaatctatgttacctaaacat

SEQ ID NO: 2847 - DNA, 60 bp, Ehrlichia chaffeensis
caactataagtttgtatacctaaaaaactattaacattaataaagacaaatttactattc

SEQ ID NO: 2848 - DNA, 60 bp, Ehrlichia chaffeensis
gtcttcaaattaaataatctaatatataaatctattagcatctttgttaaagttattgca

SEQ ID NO: 2849 - DNA, 60 bp, Ehrlichia chaffeensis
tcctatttcatttatagatatacacatcaaataagtaattaatctaaaaacacaatttgc

SEQ ID NO: 2850 - DNA, 60 bp, Ehrlichia chaffeensis
cattctatatgaaaacattatctgtcaatgtaaattacttattaactataaccgttctgt

SEQ ID NO: 2851 - DNA, 60 bp, Ehrlichia chaffeensis
ataattattatctactaaatgatttctagtatctatcacatcaaatttcttataagatcc

SEQ ID NO: 2852 - DNA, 60 bp, Ehrlichia chaffeensis
actagaatacaattagtattttacttacatattccaatccttattatacttataacaata

SEQ ID NO: 2853 - DNA, 60 bp, Ehrlichia ewingii
agtcgaacgaacaattcctaaatagtctctgactatttagatagttgttagtggcagacg

SEQ ID NO: 2854 - DNA, 60 bp, Ehrlichia ewingii
tagaaatgatgggtaatactgtataatccctgcgggggaaagatttatcgctattagatg

SEQ ID NO: 2855 - DNA, 45 bp, Ehrlichia ewingii
gggactacggtcgcaagactaaaactcaaaggaattgacggggac

SEQ ID NO: 2856 - DNA, 45 bp, Ehrlichia ewingii
gaattgacggggacccgcacaagcgtggagcatgtggtttaattc

SEQ ID NO: 2857 - DNA, 54 bp, Ehrlichia ewingii
ggagcatgtggtttaattcgatgcaacgcgaaaaaccttaccactttttgacat

SEQ ID NO: 2858 - DNA, 55 bp, Ehrlichia ewingii
aaaaaccttaccactttttgacatgaaggtcgtatcccttttaacagagggagtc

SEQ ID NO: 2859 - DNA, 46 bp, Ehrlichia ewingii
gaaactgccagtgataaactggaggaaggtggggatgatgtcaaat

SEQ ID NO: 2860 - DNA, 45 bp, Ehrlichia ewingii
gaggaaggtggggatgatgtcaaatcagcacggcccttataaggt

SEQ ID NO: 2861 - DNA, 47 bp, Ehrlichia ewingii
gaatcgctagtaatcgtggatcatcacgccacggtgaatacgttctc

SEQ ID NO: 2862 - DNA, 60 bp, Ehrlichia muris
atatcatgtgatatatcctaattctccattaaattttcaatattctacttcaaaaggtat

SEQ ID NO: 2863 - DNA, 60 bp, Ehrlichia muris
tgtagattatgataggtgtaatagtgagcataatttcctatctaatagatataatatagg

SEQ ID NO: 2864 - DNA, 60 bp, Ehrlichia muris
ttcagggcgtaaattattagcaatattaagagattgtagaatttcatctgcattatgagt

SEQ ID NO: 2865 - DNA, 60 bp, Ehrlichia muris
tctaggttctgataatacaattatattgattacagatgacatgactttaggttgaggtga

SEQ ID NO: 2866 - DNA, 60 bp, Ehrlichia muris
cttttgctatttggttgtgctactatacgatctgctacttctttttgaaacattaatgta

SEQ ID NO: 2867 - DNA, 60 bp, Ehrlichia muris
gttgcgatatggtaaggtaaatttgctatgacttttactggaggttcaactatattccgt

SEQ ID NO: 2868 - DNA, 60 bp, Ehrlichia muris
ccgatttctattattgaataatcgctaatatttccagcataattaactatcttgtctgta

SEQ ID NO: 2869 - DNA, 60 bp, Ehrlichia muris
ttaggatttatcttgttaagattatgcataattaaaatgatgtaatgataaattatgctt

SEQ ID NO: 2870 - DNA, 60 bp, Ehrlichia muris
actggcataatattacttttaggtttattaattcttgcttgggggcttattgcttccttc

SEQ ID NO: 2871 - DNA, 60 bp, Ehrlichia muris
ggctaggtttaactaaatctgcagtaaaaattacaggaatagtagttgtttgtttatgcc

SEQ ID NO: 2872 - DNA, 60 bp, Ehrlichia muris
ttgtttgtttatgcctattctcatcttttatactttatagttttttcctaagttaatggt

SEQ ID NO: 2873 - DNA, 60 bp, Ehrlichia muris; identical to SEQ ID NO: 2863

SEQ ID NO: 2874 - DNA, 60 bp, Ehrlichia muris; identical to SEQ ID NO: 2864

SEQ ID NO: 2875 - DNA, 60 bp, Ehrlichia muris; identical to SEQ ID NO: 2865

SEQ ID NO: 2876 - DNA, 60 bp, Ehrlichia muris; identical to SEQ ID NO: 2866

SEQ ID NO: 2877 - DNA, 60 bp, Ehrlichia muris; identical to SEQ ID NO: 2867

SEQ ID NO: 2878 - DNA, 60 bp, Ehrlichia muris; identical to SEQ ID NO: 2868

SEQ ID NO: 2879 - DNA, 60 bp, Ehrlichia muris
tggaaatataaacttaagaaacttctcaaaaagcatattataaatctacaacttgattga

SEQ ID NO: 2880 - DNA, 60 bp, Ehrlichia muris
cgaatgaaaagaaactactattatttttccacctggattcaataaatcagcagcattagt

SEQ ID NO: 2881 - DNA, 60 bp, Ehrlichia muris
tccacctggattcaataaatcagcagcattagttatcccatgttctaattcttctaattc

SEQ ID NO: 2882 - DNA, 60 bp, Ehrlichia muris
gcattagttatcccatgttctaattcttctaattctttattaacccatatcctaattgcc

SEQ ID NO: 2883 - DNA, 60 bp, Ehrlichia muris
cttctaattctttattaacccatatcctaattgcctgaaacgtccttgttgcaggatcaa

SEQ ID NO: 2884 - DNA, 60 bp, Ehrlichia muris
tcacaaacattgatgcatcaatactacacatagaagtattcatcctcatatcaagaggtc

SEQ ID NO: 2885 - DNA, 60 bp, Ehrlichia muris
tctaattgcatagaagaaacccctatatcaaatactataccatcaactctttgcaactga

SEQ ID NO: 2886 - DNA, 60 bp, Ehrlichia muris
tgaactagttcctcatagaaaacattagtatattcatcttgatcaatagcatagacctga

SEQ ID NO: 2887 - DNA, 54 bp, Ehrlichia muris
ctgacaatctgcagatcccaaaattgctctagtatatcctcctgctccaaatgt

SEQ ID NO: 2888 - DNA, 60 bp, Ehrlichia muris
agtatgcatatataaacttctcattcgaataacaatcattcaatcttttaacataagaga

SEQ ID NO: 2889 - DNA, 60 bp, Ehrlichia muris
tgacgcaactcggttttcctatcgctaatacttttaataatcataacactataacataca

SEQ ID NO: 2890 - DNA, 60 bp, Ehrlichia muris
aaccatcacaaaaactatatgcaaaattcaattcatcatttgagaaaccaccttctggcc

SEQ ID NO: 2891 - DNA, 60 bp, Ehrlichia muris
ttcaatagaccactttctgcatttatctaaatttatattactcgttgctatatgttttgt

SEQ ID NO: 2892 - DNA, 60 bp, Ehrlichia muris
tggaaaaacataatgttaaatctttagttataatttgctctctaaccaattcatttactc

SEQ ID NO: 2893 - DNA, 60 bp, Ehrlichia muris
agtgagaagcaagattatctaaggttataatagaacattttccaagagcacaagtcacat

SEQ ID NO: 2894 - DNA, 60 bp, Ehrlichia muris
tcagtaacttacattatctctcttattatctcaagaacattatcaacatgtccactaact

SEQ ID NO: 2895 - DNA, 60 bp, Ehrlichia muris
atacccatataagattttccaaacatattcttttctatccaaataccatattgctttgat

SEQ ID NO: 2896 - DNA, 60 bp, Ehrlichia muris
gataaatcatgcttcttcttaaaactctcatgagatttatcactatccttagacacacca

SEQ ID NO: 2897 - DNA, 60 bp, Ehrlichia muris
actctcatgagatttatcactatccttagacacaccaattataacggtattcaaatcagt

SEQ ID NO: 2898 - DNA, 60 bp, Ehrlichia muris
tgccaagcatttttaaggctcacgttgtaatattaccactttagaaataccataaacacg

SEQ ID NO: 2899 - DNA, 60 bp, Ehrlichia muris
tctttctaattctaactacaatcacactattacttttagtccaatttaattttatcaaca

SEQ ID NO: 2900 - DNA, 60 bp, Ehrlichia muris
ggaggatcaacaaaaataatatcatattgatcagcggcaacaggcaatcttgtgatatca

SEQ ID NO: 2901 - DNA, 60 bp, Ehrlichia muris
ggcaatcttgtgatatcacaacacatgagtgttatattatctactacccctaaatattca

SEQ ID NO: 2902 - DNA, 60 bp, Ehrlichia muris
tcagatgttcgtttcactaaactcaagttatagcgatttatatcaactaacaaagcactc

SEQ ID NO: 2903 - DNA, 60 bp, Ehrlichia muris
agttatagcgatttatatcaactaacaaagcactctctgcacccctagataatgcctcaa

SEQ ID NO: 2904 - DNA, 60 bp, Ehrlichia muris
tgcctcaaatgataacgatccactaccacaaaataaatcaagaactttacacccttgaat

SEQ ID NO: 2905 - DNA, 60 bp, Ehrlichia muris
caggacgtgcactaagtaatttatcagaaaatattctcctgccacgatattttcctgatg

SEQ ID NO: 2906 - DNA, 60 bp, Ehrlichia muris
tggataacaaatattcactttgcatagataacttctccatatatagcctctgcttgatga

SEQ ID NO: 2907 - DNA, 60 bp, Ehrlichia muris
cttagaaaacaataatgtttatggaaatataaagaaagttcacaattttggatcatgtga

SEQ ID NO: 2908 - DNA, 60 bp, Ehrlichia muris
aaccatatttccagagatgtttccaggaacattaaactattcagtaataggtagagcctt

SEQ ID NO: 2909 - DNA, 53 bp, Ehrlichia muris
ttttcccccctctggcatataagaaagattactttagaatcctcccatacctc

SEQ ID NO: 2910 - DNA, 60 bp, Ehrlichia muris
acacagcaaaatcaaatgctatacgaactaccttaagtggatcaataaccccagaagtaa

SEQ ID NO: 2911 - DNA, 60 bp, Ehrlichia muris
accttaagtggatcaataaccccagaagtaaaagcatttgcaaaattcattgtatcgaca

SEQ ID NO: 2912 - DNA, 60 bp, Ehrlichia muris
gagtttttaatgatacgtttaataggagcctgtaaagcacgctttacaatattaatacct

SEQ ID NO: 2913 - DNA, 57 bp, Ehrlichia muris
ctttaacttcaacttcactagatccaccaacctttaagacagcaacaccacctgata

SEQ ID NO: 2914 - DNA, 60 bp, Ehrlichia muris
acattagtagaactattatctacactgccaataatagtagtagtatcttttgtaatacgt

SEQ ID NO: 2915 - DNA, 60 bp, Ehrlichia muris
cagttaaaatagcaatatcacccaacatatcttttcttctatccccaaatcctggtgctt

SEQ ID NO: 2916 - DNA, 60 bp, Ehrlichia muris
ttagtaagatataaggattttcaaattccaccaacatcttctctgagttggttacaaaat

SEQ ID NO: 2917 - DNA, 60 bp, Ehrlichia muris
tcagttttttcaacatccaattctttgaatcccttactttcttcaactgtaataactcca

SEQ ID NO: 2918 - DNA, 60 bp, Ehrlichia muris
tttgaatcccttactttcttcaactgtaataactccatctttaccaacttcttgaacaca

SEQ ID NO: 2919 - DNA, 60 bp, Ehrlichia muris
tagtagcaacttgagcaatctcctcttcagataatacttcacgcttcatagacatcaatg

SEQ ID NO: 2920 - DNA, 60 bp, Ehrlichia muris
agaacatgtagttgttccatcaccaactttatcattacattgagaagcactctgagtaat

SEQ ID NO: 2921 - DNA, 60 bp, Ehrlichia muris
gcaatagcaagagccaatggatcctctggctttatacttttaataactttatatccatct

SEQ ID NO: 2922 - DNA, 60 bp, Ehrlichia muris
aatacgaacaacttctctaatcgatttatcgagttgttcaccagtcacaactacatttgc

SEQ ID NO: 2923 - DNA, 60 bp, Borrelia burgdorferi
tagggaagagttaatggaattagccttagtttatctttctcttagaaaggaggtgatcca

SEQ ID NO: 2924 - DNA, 51 bp, Borrelia burgdorferi
ttacgacttcacccccctcactaaacataccttaaataccttcctccctta

SEQ ID NO: 2925 - DNA, 60 bp, Borrelia burgdorferi
ttctgatatacgattactagcgattccaacttcatgaagtcgagtttcagacttcaatcc

SEQ ID NO: 2926 - DNA, 45 bp, Borrelia burgdorferi
atgatgatttgacgtcatcctcaccttcctccgacttatcaccgg

SEQ ID NO: 2927 - DNA, 50 bp, Borrelia burgdorferi
ggcagtcttatctgagtccccaccattacatgctggtaacagataacaag

SEQ ID NO: 2928 - DNA, 60 bp, Borrelia burgdorferi
cccaaacggggaataattatctctaactatatcctatatatgtcaagccctggtaaggtt

SEQ ID NO: 2929 - DNA, 47 bp, Borrelia burgdorferi
tcaagccctggtaaggttcctcgcgtatcatcgaattaaaccacatg

SEQ ID NO: 2930 - DNA, 51 bp, Borrelia burgdorferi
tttacagcgtagactaccagggtatctaatcctgtttgctccctacgcttt

SEQ ID NO: 2931 - DNA, 47 bp, Borrelia burgdorferi
tatctaatcctgtttgctccctacgctttcgtgactcagcgtcagtc

SEQ ID NO: 2932 - DNA, 48 bp, Borrelia burgdorferi
ccagaagttcgccttcgcctccggtattctttctgatatcaacagatt

SEQ ID NO: 2933 - DNA, 60 bp, Borrelia burgdorferi
ttctttctgatatcaacagattccacccttacaccagaaattctaacttcctctatcaga

SEQ ID NO: 2934 - DNA, 60 bp, Borrelia burgdorferi
cacccttacaccagaaattctaacttcctctatcagactctagacatatagtttccaaca

SEQ ID NO: 2935 - DNA, 45 bp, Borrelia burgdorferi
ctttacgcccaataatcccgaacaacgctcgccccttacgtatta

SEQ ID NO: 2936 - DNA, 60 bp, Borrelia burgdorferi
cacgtaattagccggggcttattcataaattaacgtcatcactttgtcatttcctacaaa

SEQ ID NO: 2937 - DNA, 45 bp, Borrelia burgdorferi
atctttcgaccttcttcattcacgcagtgtcgctccgtcaggctt

SEQ ID NO: 2938 - DNA, 47 bp, Borrelia burgdorferi
ctctcaggccggttacttatcattgccttggtaggcatttaccctac

SEQ ID NO: 2939 - DNA, 46 bp, Borrelia burgdorferi
gtagatcatccacgcgttactcacccgttcgccactgaatgtattg

SEQ ID NO: 2940 - DNA, 51 bp, Borrelia burgdorferi
cactgaatgtattgctacatcccgtttgacttgcatgcttaagacgcactg

SEQ ID NO: 2941 - DNA, 60 bp, Borrelia burgdorferi
ccaccagggtttttacaaggaagacaaaaatatggccaaagatacgggtaattagtatta

SEQ ID NO: 2942 - DNA, 54 bp, Borrelia burgdorferi
ctatcaacctggtattcttccaggacccttaaaggatatctcatcttgaggaag

SEQ ID NO: 2943 - DNA, 45 bp, Borrelia burgdorferi
cttacccttggcaggataactggcacactagaggttcgtccatct

SEQ ID NO: 2944 - DNA, 48 bp, Borrelia burgdorferi
ctctcaaatatccaacgcttgtggcagatagggaccaaactgtctcac

SEQ ID NO: 2945 - DNA, 45 bp, Borrelia burgdorferi
gaacagccatacccttaggacctgctccagccctaggatgcgatg

SEQ ID NO: 2946 - DNA, 52 bp, Borrelia burgdorferi
accgccagatcactaagacctactttcgtatctgttcgacttgtcagtctta

SEQ ID NO: 2947 - DNA, 50 bp, Borrelia burgdorferi
gatttccaaccactctaaggtaacctttgcgcacctccgttactctttag

SEQ ID NO: 2948 - DNA, 60 bp, Borrelia burgdorferi
ccagtcaaactacccacctggcactctcctcatatttctataagttagaaacctaattaa

SEQ ID NO: 2949 - DNA, 52 bp, Borrelia burgdorferi
ggtctttccgtctaaccacaagtaatcggcatcttcaccgatacttcaattt

SEQ ID NO: 2950 - DNA, 45 bp, Borrelia burgdorferi
gttacaccattcgtgcgggtcggaacttacccgacaaggaatttc

SEQ ID NO: 2951 - DNA, 49 bp, Borrelia burgdorferi
ttaggaccgttatagttacggccgccgtttactggggcttaaattcaat

SEQ ID NO: 2952 - DNA, 59 bp, Borrelia burgdorferi
tttactggggcttaaattcaatgcttcgcataaactaacatctcctcttaaccttccag

SEQ ID NO: 2953 - DNA, 45 bp, Borrelia burgdorferi
cagcaccgggcaggtgtcagtccctatacttctctttacagattt

SEQ ID NO: 2954 - DNA, 59 bp, Borrelia burgdorferi
gtccctatacttctctttacagatttgcagagacctgtgtttttggtaaacagtcgttt

SEQ ID NO: 2955 - DNA, 60 bp, Borrelia burgdorferi
atttgcagagacctgtgtttttggtaaacagtcgtttggaccatttttatgctacctaat

SEQ ID NO: 2956 - DNA, 47 bp, Borrelia burgdorferi
agagttccttaacgtggattctctcgcgcgccttagaattttcatcc

SEQ ID NO: 2957 - DNA, 60 bp, Borrelia burgdorferi
cttggcaccttgactacctacatttcatgctacctaaatagcactcatcatcacatctta

SEQ ID NO: 2958 - DNA, 54 bp, Borrelia burgdorferi
ttaatgcttaaactaggacaaccatcgcctagcagtagttaacctcatgcgtca

SEQ ID NO: 2959 - DNA, 45 bp, Borrelia burgdorferi
actaaccctgggaagacgacctttacccaggaaaccttaggtttt

SEQ ID NO: 2960 - DNA, 50 bp, Borrelia burgdorferi
gaaaccttaggttttcggcgaatgggaatctcacccattttttcgttact

SEQ ID NO: 2961 - DNA, 57 bp, Borrelia burgdorferi
gaatgggaatctcacccattttttcgttactcatacctgcattctcacttctgatac

SEQ ID NO: 2962 - DNA, 60 bp, Borrelia burgdorferi
ctcctaggcattcaccatagactcttattactttgaccatatttttatcttccatctcta

SEQ ID NO: 2963 - DNA, 60 bp, Borrelia burgdorferi; identical to SEQ ID NO: 2941

SEQ ID NO: 2964 - DNA, 53 bp, Borrelia burgdorferi
ctatcgacctggtattcttccaggacccttaaaggatatctcatcttgaggaa

SEQ ID NO: 2965 - DNA, 48 bp, Borrelia burgdorferi; identical to SEQ ID NO: 2944

SEQ ID NO: 2966 - DNA, 45 bp, Borrelia burgdorferi; identical to SEQ ID NO: 2945

SEQ ID NO: 2967 - DNA, 45 bp, Borrelia burgdorferi
ttttattcgttaagtgacggcgcttccacttgccaccgccagatc

SEQ ID NO: 2968 - DNA, 50 bp, Borrelia burgdorferi; identical to SEQ ID NO: 2947

SEQ ID NO: 2969 - DNA, 45 bp, Borrelia burgdorferi
ctaaggtaacctttgcgcacctccgttactctttaggaggcgacc

SEQ ID NO: 2970 - DNA, 60 bp, Borrelia burgdorferi
tcatatttctataagttagaaacctaattaaacaagggtggtatttcaagattgactcca

SEQ ID NO: 2971 - DNA, 52 bp, Borrelia burgdorferi; identical to SEQ ID NO: 2949

SEQ ID NO: 2972 - DNA, 45 bp, Borrelia burgdorferi; identical to SEQ ID NO: 2950

SEQ ID NO: 2973 - DNA, 49 bp, Borrelia burgdorferi; identical to SEQ ID NO: 2951

SEQ ID NO: 2974 - DNA, 59 bp, Borrelia burgdorferi; identical to SEQ ID NO: 2952

SEQ ID NO: 2975 - DNA, 46 bp, Borrelia burgdorferi
ccgggcaggtgtcagtccctatacttctctttacagatttgcagag

SEQ ID NO: 2976 - DNA, 59 bp, Borrelia burgdorferi; identical to SEQ ID NO: 2954

SEQ ID NO: 2977 - DNA, 60 bp, Borrelia burgdorferi; identical to SEQ ID NO: 2955

SEQ ID NO: 2978 - DNA, 47 bp, Borrelia burgdorferi; identical to SEQ ID NO: 2956

SEQ ID NO: 2979 - DNA, 60 bp, Borrelia burgdorferi
ctatttcttggcaccttgactacctacatttcatgctacctaaatagcactcatcatcac

SEQ ID NO: 2980 - DNA, 54 bp, Borrelia burgdorferi; identical to SEQ ID NO: 2958

SEQ ID NO: 2981 - DNA, 45 bp, Borrelia burgdorferi; identical to SEQ ID NO: 2959

SEQ ID NO: 2982 - DNA, 50 bp, Borrelia burgdorferi; identical to SEQ ID NO: 2960

SEQ ID NO: 2983 - DNA, 57 bp, Borrelia burgdorferi; identical to SEQ ID NO: 2961

SEQ ID NO: 2984 - DNA, 57 bp, Borrelia burgdorferi
ctgcattctcacttctgatacctccatcaaactttccagtttaacttctctggctta

SEQ ID NO: 2985 - DNA, 60 bp, Borrelia burgdorferi
gaaccttatcgcccatagtctcactcctattcatcatttaatagcattcggagtttaact

SEQ ID NO: 2986 - DNA, 60 bp, Borrelia burgdorferi
agtgctctacctctattaaactaaaataaggctgaacttaaatccatttcggggagaacc

SEQ ID NO: 2987 - DNA, 52 bp, Borrelia burgdorferi
gtctaccacatctaactaaatcgcccttttaagactcgctttcgcttcgact

SEQ ID NO: 2988 - DNA, 59 bp, Borrelia burgdorferi
cgactccagcacttctatgctttaatcttgctagacatgataactcgcaggttcattat

SEQ ID NO: 2989 - DNA, 54 bp, Borrelia burgdorferi
atgataactcgcaggttcattatgcaaaaggcacgccatcaccgcaataaatta

SEQ ID NO: 2990 - DNA, 58 bp, Borrelia burgdorferi
aataaattacggctttgactgcttgtaagtctacggtttcagttctatttcactcccc

SEQ ID NO: 2991 - DNA, 60 bp, Borrelia burgdorferi; identical to SEQ ID NO: 2962

SEQ ID NO: 2992 - DNA, 60 bp, Borrelia burgdorferi
aaggctgatagagtaactacccaattcagacatttaaattttccatattactcagattca

SEQ ID NO: 2993 - DNA, 60 bp, Borrelia burgdorferi
cccctgtcccaacttattatctcccaatgaataccatgagcctgttttttgtattaaatt

SEQ ID NO: 2994 - DNA, 60 bp, Borrelia burgdorferi
ccttgttctttacaatcttaactctaatcttattgccaataacatcatcgcttgagcccg

SEQ ID NO: 2995 - DNA, 60 bp, Borrelia burgdorferi
ctcaggattgccaaacataacaccaatcctcatccttatttgattaataaacataatgca

SEQ ID NO: 2996 - DNA, 60 bp, Borrelia burgdorferi
cttgaagaccaatctgagaatctcccatttctccatctatctctaatttaggggttaaag

SEQ ID NO: 2997 - DNA, 60 bp, Borrelia burgdorferi
agaatcaactacaatcaaatcaacaccaccacttctgattaaatgctcagcaatctcaag

SEQ ID NO: 2998 - DNA, 56 bp, Borrelia burgdorferi
gcttgaagagttaaagtagtcttgccagacgactcggggccaaaaatttctattat

SEQ ID NO: 2999 - DNA, 48 bp, Borrelia burgdorferi
caaaaatttctattatgcgccccctaggatatccgccaatgccgagag

SEQ ID NO: 3000 - DNA, 52 bp, Borrelia burgdorferi
ctaggatatccgccaatgccgagagcctcatctaatacaatagatccacttg

SEQ ID NO: 3001 - DNA, 60 bp, Borrelia burgdorferi
agcctcatctaatacaatagatccacttgacatactttttataccttgtccaacaggaga

SEQ ID NO: 3002 - DNA, 51 bp, Coxiella burnetii
aaagtgtaggttttcaacaagtagcccaatgaaatggacccaccccttaaa

SEQ ID NO: 3003 - DNA, 58 bp, Coxiella burnetii
aaaagatgtttttcaactgtgtggaattgatgagtggggtaaagtgatctacacgaga

SEQ ID NO: 3004 - DNA, 50 bp, Coxiella burnetii
ggtaaagtgatctacacgagacgggttaagcgtgctcagtatgtatccac

SEQ ID NO: 3005 - DNA, 45 bp, Coxiella burnetii
gatggaagcgtgtggaggagcgaaccattggtatcggacgtttat

SEQ ID NO: 3006 - DNA, 45 bp, Coxiella burnetii
tatcggacgtttatggggatgggtatcccaacgcagttgatcagt

SEQ ID NO: 3007 - DNA, 54 bp, Coxiella burnetii
atcagtccgcagcacgtcaaaccgtatgtcaaaagtaacaagaatgatcgtaac

SEQ ID NO: 3008 - DNA, 50 bp, Coxiella burnetii
gtaaaacggtggaacaacaagacgttcaagcgctgttaaagatacgcgat

SEQ ID NO: 3009 - DNA, 54 bp, Coxiella burnetii
gaacaacaagacgttcaagcgctgttaaagatacgcgatcgtttagtcaaaagc

SEQ ID NO: 3010 - DNA, 47 bp, Coxiella burnetii
ctgatcaatgagattcgggggttgttgcaagaatacggactcacgat

SEQ ID NO: 3011 - DNA, 51 bp, Coxiella burnetii
atgaaacgggtgttgaattgtttgtataccgaattgttgaaccgggacgaa

SEQ ID NO: 3012 - DNA, 50 bp, Coxiella burnetii
aattgttgaaccgggacgaagcgattggtgattacgaggaggaattaaaa

SEQ ID NO: 3013 - DNA, 47 bp, Coxiella burnetii
ctctcggtttatgcgagcgtgggtgacattcatcaatttcatcgttc

SEQ ID NO: 3014 - DNA, 48 bp, Coxiella burnetii
gtgacattcatcaatttcatcgttcccggcagttgtcggcgtttattg

SEQ ID NO: 3015 - DNA, 46 bp, Coxiella burnetii
gtttattgggttggtccctcgacaacattcgagtgggaataaggag

SEQ ID NO: 3016 - DNA, 50 bp, Coxiella burnetii
ctcgacaacattcgagtgggaataaggaggtgttgttggggattagtaaa

SEQ ID NO: 3017 - DNA, 53 bp, Coxiella burnetii
ttggggattagtaaacgcggcaatgtgatgttaaggacgttattgattcatgg

SEQ ID NO: 3018 - DNA, 45 bp, Coxiella burnetii
taaaagcactcattgagcgccgcggaatgaatcgcgcttgtgtgg

SEQ ID NO: 3019 - DNA, 52 bp, Coxiella burnetii
gaataaaaatgcgccgatcatttgggcgcttttaacacgccaagaaacgtat

SEQ ID NO: 3020 - DNA, 51 bp, Coxiella burnetii
acacaccaaccgagttcgaaacaatgagggctgatgaaagtaaggtaaaac

SEQ ID NO: 3021 - DNA, 50 bp, Coxiella burnetii; identical to SEQ ID NO: 3008

SEQ ID NO: 3022 - DNA, 54 bp, Coxiella burnetii; identical to SEQ ID NO: 3009

SEQ ID NO: 3023 - DNA, 47 bp, Coxiella burnetii; identical to SEQ ID NO: 3010

SEQ ID NO: 3024 - DNA, 51 bp, Coxiella burnetii; identical to SEQ ID NO: 3011

SEQ ID NO: 3025 - DNA, 50 bp, Coxiella burnetii; identical to SEQ ID NO: 3012

SEQ ID NO: 3026 - DNA, 47 bp, Coxiella burnetii; identical to SEQ ID NO: 3013

SEQ ID NO: 3027 - DNA, 48 bp, Coxiella burnetii; identical to SEQ ID NO: 3014

SEQ ID NO: 3028 - DNA, 46 bp, Coxiella burnetii; identical to SEQ ID NO: 3015

SEQ ID NO: 3029 - DNA, 50 bp, Coxiella burnetii; identical to SEQ ID NO: 3016

SEQ ID NO: 3030 - DNA, 53 bp, Coxiella burnetii; identical to SEQ ID NO: 3017

SEQ ID NO: 3031 - DNA, 45 bp, Coxiella burnetii; identical to SEQ ID NO: 3018

SEQ ID NO: 3032 - DNA, 52 bp, Coxiella burnetii; identical to SEQ ID NO: 3019

SEQ ID NO: 3033 - DNA, 51 bp, Coxiella burnetii; identical to SEQ ID NO: 3020

SEQ ID NO: 3034 - DNA, 47 bp, Coxiella burnetii
aaatgatcggcgcatttttattcgctaacgccacacaagcgcgattc

SEQ ID NO: 3035 - DNA, 45 bp, Coxiella burnetii
cacacaagcgcgattcattccgcggcgctcaatgagtgcttttaa

SEQ ID NO: 3036 - DNA, 54 bp, Coxiella burnetii
catgaatcaataacgtccttaacatcacattgccgcgtttactaatccccaaca

SEQ ID NO: 3037 - DNA, 50 bp, Coxiella burnetii
tttactaatccccaacaacacctccttattcccactcgaatgttgtcgag

SEQ ID NO: 3038 - DNA, 48 bp, Coxiella burnetii
caataaacgccgacaactgccgggaacgatgaaattgatgaatgtcac

SEQ ID NO: 3039 - DNA, 47 bp, Coxiella burnetii
gaacgatgaaattgatgaatgtcacccacgctcgcataaaccgagag

SEQ ID NO: 3040 - DNA, 49 bp, Coxiella burnetii
tttaattcctcctcgtaatcaccaatcgcttcgtcccggttcaacaatt

SEQ ID NO: 3041 - DNA, 54 bp, Coxiella burnetii
gttcaacaattcggtatacaaacaattcaacacccgtttcatccgcggtgttaa

SEQ ID NO: 3042 - DNA, 45 bp, Coxiella burnetii
gtgagtccgtattcttgcaacaacccccgaatctcattgatcagc

SEQ ID NO: 3043 - DNA, 48 bp, Coxiella burnetii
attgatcagcgccgtgcggcttttgactaaacgatcgcgtatctttaa

SEQ ID NO: 3044 - DNA, 52 bp, Coxiella burnetii
ttgactaaacgatcgcgtatctttaacagcgcttgaacgtcttgttgttcca

SEQ ID NO: 3045 - DNA, 45 bp, Coxiella burnetii
ttgaacgtcttgttgttccaccgttttaccctgcacaaaccgcat

SEQ ID NO: 3046 - DNA, 54 bp, Coxiella burnetii
gttacgatcattcttgttacttttgacatacggtttgacgtgctgcggactgat

SEQ ID NO: 3047 - DNA, 45 bp, Coxiella burnetii
ctgatcaactgcgttgggatacccatccccataaacgtccgatac

SEQ ID NO: 3048 - DNA, 45 bp, Coxiella burnetii
gataccaatggttcgctcctccacacgcttccatcaccacgcagc

SEQ ID NO: 3049 - DNA, 50 bp, Coxiella burnetii
gtggatacatactgagcacgcttaacccgtctcgtgtagatcactttacc

SEQ ID NO: 3050 - DNA, 58 bp, Coxiella burnetii
tctcgtgtagatcactttaccccactcatcaattccacacagttgaaaaacatctttt

SEQ ID NO: 3051 - DNA, 57 bp, Coxiella burnetii
catttcattgggctacttgttgaaaacctacactttcaattgcacctatgaacgagc

SEQ ID NO: 3052 - DNA, 54 bp, Coxiella burnetii; identical to SEQ ID NO: 3007

SEQ ID NO: 3053 - DNA, 50 bp, Coxiella burnetii; identical to SEQ ID NO: 3008

SEQ ID NO: 3054 - DNA, 54 bp, Coxiella burnetii; identical to SEQ ID NO: 3009

SEQ ID NO: 3055 - DNA, 47 bp, Coxiella burnetii; identical to SEQ ID NO: 3010

SEQ ID NO: 3056 - DNA, 51 bp, Coxiella burnetii; identical to SEQ ID NO: 3011

SEQ ID NO: 3057 - DNA, 50 bp, Coxiella burnetii; identical to SEQ ID NO: 3012

SEQ ID NO: 3058 - DNA, 47 bp, Coxiella burnetii; identical to SEQ ID NO: 3013

SEQ ID NO: 3059 - DNA, 48 bp, Coxiella burnetii; identical to SEQ ID NO: 3014

SEQ ID NO: 3060 - DNA, 46 bp, Coxiella burnetii; identical to SEQ ID NO: 3015

SEQ ID NO: 3061 - DNA, 50 bp, Coxiella burnetii; identical to SEQ ID NO: 3016

SEQ ID NO: 3062 - DNA, 53 bp, Coxiella burnetii; identical to SEQ ID NO: 3017

SEQ ID NO: 3063 - DNA, 45 bp, Coxiella burnetii; identical to SEQ ID NO: 3018

SEQ ID NO: 3064 - DNA, 52 bp, Coxiella burnetii; identical to SEQ ID NO: 3019

SEQ ID NO: 3065 - DNA, 51 bp, Coxiella burnetii; identical to SEQ ID NO: 3020

SEQ ID NO: 3066 - DNA, 51 bp, Coxiella burnetii
ctctgtgaagccgatagcccgataagcatcaaccttgcataattcatcaag

SEQ ID NO: 3067 - DNA, 56 bp, Coxiella burnetii
ataagcatcaaccttgcataattcatcaaggcaccaatggtggccaatttaaatcg

SEQ ID NO: 3068 - DNA, 60 bp, Coxiella burnetii
aatttaaatcgtgatgccggatatacgaatgcaaccgctttcttttcatcaaaactgatt

SEQ ID NO: 3069 - DNA, 57 bp, Coxiella burnetii
ctagattggctatttatctgtagtaaaaagaacggttgcatcgccaaagagcgtgtc

SEQ ID NO: 3070 - DNA, 50 bp, Coxiella burnetii
taatggcggaaccatctaaattgatttttgccatagtggaaacagggacg

SEQ ID NO: 3071 - DNA, 45 bp, Coxiella burnetii
aaatgacgccgatgacgataacgccagtgatggcccctatagaag

SEQ ID NO: 3072 - DNA, 48 bp, Coxiella burnetii
tatagaagcgcctagggtagcagacccaaaaaccacgaaaacgatgtt

SEQ ID NO: 3073 - DNA, 47 bp, Coxiella burnetii
aaaaaccacgaaaacgatgttgcgctaactgcacgggcttattggat

SEQ ID NO: 3074 - DNA, 60 bp, Coxiella burnetii
aagcaaatactgaattttatcctttccatagatgttctccattattctgcgtttagacct

SEQ ID NO: 3075 - DNA, 47 bp, Coxiella burnetii; identical to SEQ ID NO: 3039

SEQ ID NO: 3076 - DNA, 49 bp, Coxiella burnetii; identical to SEQ ID NO: 3040

SEQ ID NO: 3077 - DNA, 54 bp, Coxiella burnetii; identical to SEQ ID NO: 3041

SEQ ID NO: 3078 - DNA, 45 bp, Coxiella burnetii; identical to SEQ ID NO: 3042

SEQ ID NO: 3079 - DNA, 48 bp, Coxiella burnetii; identical to SEQ ID NO: 3043

SEQ ID NO: 3080 - DNA, 52 bp, Coxiella burnetii; identical to SEQ ID NO: 3044

SEQ ID NO: 3081 - DNA, 45 bp, Coxiella burnetii
ttgaacgtcttgttgttccaccgttttaccccgcacaaaccgcat

SEQ ID NO: 3082 - DNA, 54 bp, Coxiella burnetii; identical to SEQ ID NO: 3046

SEQ ID NO: 3083 - DNA, 45 bp, Coxiella burnetii; identical to SEQ ID NO: 3047

SEQ ID NO: 3084 - DNA, 45 bp, Coxiella burnetii; identical to SEQ ID NO: 3048

SEQ ID NO: 3085 - DNA, 50 bp, Coxiella burnetii; identical to SEQ ID NO: 3049

SEQ ID NO: 3086 - DNA, 60 bp, Trypanosoma brucei
tgagtggttttttagcattatatgtagtattagcatatccaatatgaatggaattacaat

SEQ ID NO: 3087 - DNA, 60 bp, Trypanosoma brucei
accaattttaggtatatgattatgttattgaatttggggaagtgaatttataaacgattt

SEQ ID NO: 3088 - DNA, 52 bp, Trypanosoma brucei
gttttgaaaacacccatttttaggaggataagaggggagaaaaggggaaatg

SEQ ID NO: 3089 - DNA, 56 bp, Trypanosoma brucei
tttaagttatgggagagaagcaaggaggagaaaagtaggggaattttgaggagatt

SEQ ID NO: 3090 - DNA, 60 bp, Trypanosoma brucei
tctgatgcattttgtgataggtttgcattttattgtgaaagattaagtttttgtatgtgg

SEQ ID NO: 3091 - DNA, 45 bp, Trypanosoma brucei
gagattcttggggagaggcgggcgggcgacggcggttttgaaaac

SEQ ID NO: 3092 - DNA, 60 bp, Trypanosoma brucei
ttatagataatatcattgtatatatattaacaaataagccattaacaggtagatgaagtg

SEQ ID NO: 3093 - DNA, 49 bp, Trypanosoma brucei
gcagatttcaccatacacaaatcccgtgctattttggggggtttttgag

SEQ ID NO: 3094 - DNA, 55 bp, Trypanosoma brucei
ggttggtgtaatactcacacggtttttcctcgagattttcatgattttggtgttt

SEQ ID NO: 3095 - DNA, 60 bp, Trypanosoma brucei
cagaaaacagtataattttagtagtataggataaaatatctacagaaatatggcaaggtg

SEQ ID NO: 3096 - DNA, 60 bp, Trypanosoma brucei
cttgaagtaattatagataatatcattgtatatatattaacaaataagccattaacaggt

SEQ ID NO: 3097 - DNA, 57 bp, Trypanosoma brucei
gtaatactcacacggtttttcctcgagattttcatgattttggtgtttgtgggtttc

SEQ ID NO: 3098 - DNA, 45 bp, Trypanosoma cruzi
cggatagttcagggttgtttggtgtccagtgtgtgaacacgcaaa

SEQ ID NO: 3099 - DNA, 46 bp, Leishmania major
ctaaggtcaacccaagaccaccatcggctaaccattaaagtcaacc

SEQ ID NO: 3100 - DNA, 47 bp, Leishmania major
agcatcatcaagaacacccgtagagtaacaccgaagcacccactaat

SEQ ID NO: 3101 - DNA, 45 bp, Leishmania major
actaatccaccacacaagcctccaccaggctccaacccactaaag

SEQ ID NO: 3102 - DNA, 60 bp, Leishmania major
actaaattaatgtatacttaacactacctcagactgagtcttcggagtcgaactaatcta

SEQ ID NO: 3103 - DNA, 45 bp, Leishmania major
caccaggctccaacccactaaagccacacaaccaacaccccaaag

SEQ ID NO: 3104 - DNA, 60 bp, Leishmania major
cctcgcaattcataattctcaattcactgcagtatgcgctaacctataaatgatatagat

SEQ ID NO: 3105 - DNA, 45 bp, Leishmania major
gaaacccagagtcaagcccaaaaagacctcagaagtcccaccaag

SEQ ID NO: 3106 - DNA, 45 bp, Leishmania major
cataggtaaaccgaagccaggcctccagcagccagtcctagaaag

SEQ ID NO: 3107 - DNA, 45 bp, Leishmania major
agttctaggcagagccacggagatccgatcaggacacccatattc

SEQ ID NO: 3108 - DNA, 45 bp, Leishmania major
cgtaaccgaagcctgaacggcccgacaacaagaagcataggtaaa

SEQ ID NO: 3109 - DNA, 47 bp, Leishmania major
aagacgtgactgacgaccgcatactgttagtcccatcatgacgtaac

SEQ ID NO: 3110 - DNA, 45 bp, Leishmania major
ccagcaacccggttccagactggtcccagatggaaccagttctag

SEQ ID NO: 3111 - DNA, 53 bp, Leishmania major
aacaaagactaggtataactccaacctaagcctacagagcccagtcaaaagac

SEQ ID NO: 3112 - DNA, 53 bp, Leishmania major
taagtccagtaactaagagccaaggtccgcacaacaaagactaggtataactc

SEQ ID NO: 3113 - DNA, 46 bp, Leishmania major
aaaaagccacgctagacccaagttcccctgagtccagcgctcgaaa

SEQ ID NO: 3114 - DNA, 60 bp, Babesia microti
aaacagttatagtttatttgatgttcgttttacatggataaccgtggtaattctagggct

SEQ ID NO: 3115 - DNA, 50 bp, Babesia microti
ctaatacatgctcgaggcgcgttttcgcgtggcgtttattagactttaac

SEQ ID NO: 3116 - DNA, 60 bp, Babesia microti
gtggcgtttattagactttaaccaacccttcgggtaatcggtgattcataataaattagc

SEQ ID NO: 3117 - DNA, 45 bp, Babesia microti
tgacggggaattggggttcgattccggagagggagcctgagaaac

SEQ ID NO: 3118 - DNA, 45 bp, Babesia microti
ttcgattccggagagggagcctgagaaacggctaccacatctaag

SEQ ID NO: 3119 - DNA, 45 bp, Babesia microti
taccacatctaaggaaggcagcaggcgcgcaaattacccaatcct

SEQ ID NO: 3120 - DNA, 53 bp, Babesia microti
aaattacccaatcctgacacagggaggtagtgacaagaaataacaatacaggg

SEQ ID NO: 3121 - DNA, 60 bp, Babesia microti
gaaataacaatacagggcttaaagtcttgtaattggaatgatgggaatctaaacccttcc

SEQ ID NO: 3122 - DNA, 60 bp, Babesia microti
aaactagagtgtttcaaacaggcattcgccttgaatactacagcatggaataatgaagta

SEQ ID NO: 3123 - DNA, 60 bp, Babesia microti
attcgccttgaatactacagcatggaataatgaagtaggactttggttctattttgttgg

SEQ ID NO: 3124 - DNA, 55 bp, Babesia microti
tattttgttggttattgagccagagtaatggttaataggagcagttgggggcatt

SEQ ID NO: 3125 - DNA, 60 bp, Babesia microti
gttaataggagcagttgggggcattcgtatttaactgtcagaggtgaaattcttagattt

SEQ ID NO: 3126 - DNA, 60 bp, Babesia microti
cgtatttaactgtcagaggtgaaattcttagatttgttaaagacgaactactgcgaaagc

SEQ ID NO: 3127 - DNA, 57 bp, Babesia microti
ccaaggatgttttcattaatcaagaacgaaagttaggggatcgaagacgatcagata

SEQ ID NO: 3128 - DNA, 55 bp, Babesia microti
gaagacgatcagataccgtcgtagtcctaaccataaactatgccgactagagatt

SEQ ID NO: 3129 - DNA, 55 bp, Babesia microti
cgtagtcctaaccataaactatgccgactagagattggaggtcgtcagtttaaac

SEQ ID NO: 3130 - DNA, 53 bp, Babesia microti
aggtcgtcagtttaaacgactccttcagcaccttgagagaaatcaaagtcttt

SEQ ID NO: 3131 - DNA, 45 bp, Babesia microti
agcaccttgagagaaatcaaagtctttgggttctggggggagtat

SEQ ID NO: 3132 - DNA, 47 bp, Babesia microti
gagtatggtcgcaagtctgaaacttaaaggaattgacggaagggcac

SEQ ID NO: 3133 - DNA, 45 bp, Babesia microti
gcgtggagcctgcggcttaatttgactcaacacgggaaacctcac

SEQ ID NO: 3134 - DNA, 60 bp, Babesia microti
agtgatttgtctggttaattccgttaacgaacgagaccttaacctgctaaattaggatct

SEQ ID NO: 3135 - DNA, 49 bp, Babesia microti
caaggaagtgtaaggcaataacaggtctgtgatgcccttagatgtcctg

SEQ ID NO: 3136 - DNA, 45 bp, Babesia microti
aacgagtttttccttggccgtcgggtccgggtaatcttacagtat

SEQ ID NO: 3137 - DNA, 60 bp, Babesia microti
ggtccgggtaatcttacagtatgcatcgtgatggggatagattattgcaattattaatct

SEQ ID NO: 3138 - DNA, 56 bp, Babesia microti
tgaattattcggaccaagaaacgtggattcgtccttcgttttttggaaagttttgt

SEQ ID NO: 3139 - DNA, 60 bp, Babesia microti
tttttggaaagttttgtgaaccttatcacttaaaggaaggagaagtcgtaacaaggtttc

SEQ ID NO: 3140 - DNA, 51 bp, Babesia microti
aaggatcattcttatcagagttctttgtatcccatttgggttacgctggcc

SEQ ID NO: 3141 - DNA, 45 bp, Babesia microti
ctttgtatcccatttgggttacgctggcccgtgcgcttggtcgca

SEQ ID NO: 3142 - DNA, 45 bp, Babesia microti
cttctagaagagtggccttggacgtagcggctgcaactttgttga

SEQ ID NO: 3143 - DNA, 45 bp, Babesia microti
aactttgttgagccgcatccctgtgtggcgcaagcgcgtcggaag

SEQ ID NO: 3144 - DNA, 45 bp, Babesia microti
gtttgtctgcacggggcgttctcactcccaaggtattttccctgg

SEQ ID NO: 3145 - DNA, 49 bp, Babesia microti
ctcactcccaaggtattttccctgggcctctgtgttagatcattctaac

SEQ ID NO: 3146 - DNA, 51 bp, Babesia microti
gttagatcattctaacgggcattgggggattatactgtttccgctgagaag

SEQ ID NO: 3147 - DNA, 45 bp, Babesia microti
attatactgtttccgctgagaagtgcccctgtggctttcttggct

SEQ ID NO: 3148 - DNA, 60 bp, Babesia microti
tttgtctccggataagggtccatgcgagcgtttgtcttaacaactactatgaatattaaa

SEQ ID NO: 3149 - DNA, 60 bp, Babesia microti
tgcgagcgtttgtcttaacaactactatgaatattaaacgaaacaaattttcagcggtgg

SEQ ID NO: 3150 - DNA, 50 bp, Babesia microti
ctcacacaacgatgaaggacgcagcgaagtgcgataatcattgtgaattg

SEQ ID NO: 3151 - DNA, 57 bp, Babesia microti
ctaaagtatacctttttccaagttatgctttgtgagtggtgcgcaacaggttttctg

SEQ ID NO: 3152 - DNA, 51 bp, Babesia microti
gtgactgacgcgtttatcacgcagaaggttctttgaaacttggacttgttt

SEQ ID NO: 3153 - DNA, 56 bp, Babesia microti
cagaaggttctttgaaacttggacttgtttgtgtggtagatagtttagttagccgc

SEQ ID NO: 3154 - DNA, 58 bp, Babesia microti
gtttgtgtggtagatagtttagttagccgcgcagcgtagatagaaatacgttgttgat

SEQ ID NO: 3155 - DNA, 48 bp, Plasmodium falciparum
atgttagggtattggcctaacatggctatgacgggtaacggggaatta

SEQ ID NO: 3156 - DNA, 60 bp, Plasmodium falciparum
aggcgcgtaaattacccaattctaaagaagagaggtagtgacaagaaataacaatgcaag

SEQ ID NO: 3157 - DNA, 50 bp, Plasmodium falciparum
aatggtgggaatttaaaaccttcccagagtaacaattggagggcaagtct

SEQ ID NO: 3158 - DNA, 60 bp, Plasmodium falciparum
aattgttgcagttaaaacgctcgtagttgaatttcaaagaatcgatattttattgtaact

SEQ ID NO: 3159 - DNA, 60 bp, Plasmodium falciparum
gcaaacagttaaagcatttactgtgtttgaatactatagcatggaataacaaaattgaac

SEQ ID NO: 3160 - DNA, 59 bp, Plasmodium falciparum
gacattcgtattcagatgtcagaggtgaaattcttagattttctggagacgaacaactg

SEQ ID NO: 3161 - DNA, 60 bp, Plasmodium falciparum
gaaattcttagattttctggagacgaacaactgcgaaagcatttgtctaaaatacttcca

SEQ ID NO: 3162 - DNA, 60 bp, Plasmodium falciparum
taaaatacttccattaatcaagaacgaaagttaagggagtgaagacgatcagataccgtc

SEQ ID NO: 3163 - DNA, 47 bp, Plasmodium falciparum
gagtattcgcgcaagcgagaaagttaaaagaattgacggaagggcac

SEQ ID NO: 3164 - DNA, 60 bp, Plasmodium falciparum
tttgactcaacacggggaaactcactagtttaagacaagagtaggattgacagattaata

SEQ ID NO: 3165 - DNA, 60 bp, Plasmodium falciparum
agttcgtgaatatgatttgtctggttaattccgataacgaacgagatcttaacctgctaa

SEQ ID NO: 3166 - DNA, 55 bp, Plasmodium falciparum
gtctgtgatgtccttagatgaactaggctgcacgcgtgctacactgatatatata

SEQ ID NO: 3167 - DNA, 60 bp, Plasmodium falciparum
tcaatatatatcgtgatggggatagattattgcaattattaatcttgaacgaggaatgcc

SEQ ID NO: 3168 - DNA, 60 bp, Plasmodium falciparum
ttattaatcttgaacgaggaatgcctagtaagcatgattcatcagattgtgctgactacg

SEQ ID NO: 3169 - DNA, 60 bp, Plasmodium falciparum
tgtaagtaatatattgaaactgcgaacggctcattaaaacagttataatctacttgatgt

SEQ ID NO: 3170 - DNA, 53 bp, Plasmodium falciparum
ttttgatgttagggtattgacctaacatggctatgacgggtaacggggaatta

SEQ ID NO: 3171 - DNA, 60 bp, Plasmodium falciparum
gagaggtagtgacaagaaataacaatacaatatcgaaaaatgattttgtaattggaatga

SEQ ID NO: 3172 - DNA, 60 bp, Plasmodium falciparum
atatcgaaaaatgattttgtaattggaatgataggaatttacaaggttcctagagaaaca

SEQ ID NO: 3173 - DNA, 51 bp, Plasmodium falciparum
ataggaatttacaaggttcctagagaaacaattggagggcaagtctggtgc

SEQ ID NO: 3174 - DNA, 60 bp, Plasmodium falciparum
gcatatattaaaattgttgcagttaaaacgttcgtagttgaatattaaagaatccgatgt

SEQ ID NO: 3175 - DNA, 60 bp, Plasmodium falciparum
gaggttttgttactttgagtaaaattaagtgttcataacagacgggtagtcatgattgag

SEQ ID NO: 3176 - DNA, 60 bp, Plasmodium falciparum
aagtgttcataacagacgggtagtcatgattgagttcattgtgtttgaatactacagcat

SEQ ID NO: 3177 - DNA, 57 bp, Plasmodium falciparum
tattcagatgtcagaggtgaaattctaagattttctggagacggactactgcgaaag

SEQ ID NO: 3178 - DNA, 60 bp, Plasmodium falciparum
ctaagattttctggagacggactactgcgaaagcatttgcctaatctatttccattaatc

SEQ ID NO: 3179 - DNA, 60 bp, Plasmodium falciparum
cctaatctatttccattaatcaagaacgaaagttaagggagtgaagacgatcagataccg

SEQ ID NO: 3180 - DNA, 47 bp, Plasmodium falciparum; identical to SEQ ID NO: 3163

SEQ ID NO: 3181 - DNA, 60 bp, Plasmodium falciparum
cttaatttgactcaacacgggaaaactcactagtttaagacaagagtaggattgacagat

SEQ ID NO: 3182 - DNA, 60 bp, Plasmodium falciparum
atgatttgtctggttaattccgataacgaacgagatcttaacctgctaattagcggtaag

SEQ ID NO: 3183 - DNA, 50 bp, Plasmodium falciparum
ttaaggcaacaacaggtctgtgatgtccttagataaactaggctgcacgc

SEQ ID NO: 3184 - DNA, 60 bp, Plasmodium falciparum
gatgtccttagataaactaggctgcacgcgtgctacaatgatatatataacaagttgtta

SEQ ID NO: 3185 - DNA, 60 bp, Plasmodium falciparum
attattgcaattattaatcttgaacgaggaagcccgtcgctcctaccgattgaaagatat

SEQ ID NO: 3186 - DNA, 60 bp, Plasmodium vivax
tctgttcaattttatgctatattgattgagtgttgtttatgaaaggcatcatggtggggt

SEQ ID NO: 3187 - DNA, 52 bp, Plasmodium vivax
ttatgaaaggcatcatggtggggttaagaaggaccttgcaatgaaagactag

SEQ ID NO: 3188 - DNA, 60 bp, Plasmodium vivax
ggaccttgcaatgaaagactagcatttgtaggtatgttactcttaacttttagtaggtgc

SEQ ID NO: 3189 - DNA, 60 bp, Plasmodium vivax
aacttttagtaggtgcaataattcctatcataaagttatatggaaagataacgaaatggt

SEQ ID NO: 3190 - DNA, 60 bp, Plasmodium vivax
acgaagtgtgtttatacagcaaatggagtgtagtgtttaaagtgtctacaaatgtgcact

SEQ ID NO: 3191 - DNA, 60 bp, Plasmodium vivax
tagtgtttaaagtgtctacaaatgtgcacttctcacttccccactgccgtatatagtaac

SEQ ID NO: 3192 - DNA, 54 bp, Plasmodium vivax
ccactgccgtatatagtaacctggttgatcttgccagtagtcatatgcttgtct

SEQ ID NO: 3193 - DNA, 60 bp, Plasmodium vivax
gaactcgcaacggctcattaaaacagttataatctacttgacattttttctataaggata

SEQ ID NO: 3194 - DNA, 56 bp, Plasmodium vivax
caaagaagcgacacgtaatggatccgtccatttttagtgtgtatcaatcgagttct

SEQ ID NO: 3195 - DNA, 49 bp, Plasmodium vivax
tattggcctaacatggctatgacgggtaacggggaattagagttcgatt

SEQ ID NO: 3196 - DNA, 60 bp, Plasmodium vivax
caattctaaagaagagaggtagtgacaagaaataacaatacaaggccaatctggctttgt

SEQ ID NO: 3197 - DNA, 60 bp, Plasmodium vivax
agtgacaagaaataacaatacaaggccaatctggctttgtaattggaatgatgggaattt

SEQ ID NO: 3198 - DNA, 60 bp, Plasmodium vivax
caatctggctttgtaattggaatgatgggaatttaaaaccttcccaaaactcaattggag

SEQ ID NO: 3199 - DNA, 51 bp, Plasmodium vivax
aatgatgggaatttaaaaccttcccaaaactcaattggagggcaagtctgg

SEQ ID NO: 3200 - DNA, 60 bp, Plasmodium vivax
tgttgcagttaaaacgctcgtagttgaatttcaaagaatcgatattttaagcaacgcttc

SEQ ID NO: 3201 - DNA, 60 bp, Plasmodium vivax
agcaaacagatatagcattgcgccgtttgaatactacagcatggaataacaaattgaaca

SEQ ID NO: 3202 - DNA, 60 bp, Plasmodium vivax
ttttctggagacaaacaactgcgaaagcatttgcctaaaatacttccattaatcaagaac

SEQ ID NO: 3203 - DNA, 60 bp, Plasmodium vivax
gcctaaaatacttccattaatcaagaacgaaagttaagggagtgaagacgatcagatacc

SEQ ID NO: 3204 - DNA, 47 bp, Plasmodium vivax
agtattcgcgcaagcgagaaagttaaaagaattcggaagggcaccac

SEQ ID NO: 3205 - DNA, 60 bp, Plasmodium vivax; identical to SEQ ID NO: 3181

SEQ ID NO: 3206 - DNA, 60 bp, Plasmodium vivax; identical to SEQ ID NO: 3165

SEQ ID NO: 3207 - DNA, 60 bp, Plasmodium vivax
acgagatcttaacctgctaattagcggcaaatacgatatattcttacgtgggactgaatt

SEQ ID NO: 3208 - DNA, 45 bp, Artificial sequence
  Synthetic oligonucleotide probe
attccgactttcaaacagcctttggactcaggccttggggacatt

SEQ ID NO: 3209 - DNA, 48 bp, Artificial sequence
  Synthetic oligonucleotide probe
gacttgagcacttcaccagtcctgactcagtttcctagtctgtgaatg

SEQ ID NO: 3210 - DNA, 45 bp, Artificial sequence
  Synthetic oligonucleotide probe
gagggcgctgcagtgcccagggcaaggtggctgggtggttgtttt

SEQ ID NO: 3211 - DNA, 45 bp, Artificial sequence
  Synthetic oligonucleotide probe
caaggtggctgggtggttgttttgcgggagggccaaggagtggtc

SEQ ID NO: 3212 - DNA, 45 bp, Artificial sequence
  Synthetic oligonucleotide probe
aaggagtggtccctgggtctgcgctgtaagagttggttgcctgga

SEQ ID NO: 3213 - DNA, 45 bp, Artificial sequence
  Synthetic oligonucleotide probe
cttggctgagttcaaccgagggttctccgggggctgcgtgcgtgc

SEQ ID NO: 3214 - DNA, 45 bp, Artificial sequence
  Synthetic oligonucleotide probe
caagcacagaagagaacctgttcacttctcccctgctcggcccgc

SEQ ID NO: 3215 - DNA, 45 bp, Artificial sequence
  Synthetic oligonucleotide probe
gcagtcactcattcaacagcgaggagccctggggtgggtgtagtg

SEQ ID NO: 3216 - DNA, 45 bp, Artificial sequence
  Synthetic oligonucleotide probe
gtgtagtgggaaggagtgggggtgacggagaccctgggagggctc

SEQ ID NO: 3217 - DNA, 45 bp, Artificial sequence
  Synthetic oligonucleotide probe
ctaaaacgcttccccaaagaggggctttctgggatgggacttgaa

SEQ ID NO: 3218 - DNA, 45 bp, Artificial sequence
  Synthetic oligonucleotide probe
ctttctgggatgggacttgaagggtgcataggagagcactaggaa

SEQ ID NO: 3219 - DNA, 45 bp, Artificial sequence
  Synthetic oligonucleotide probe
ataggagagcactaggaagtggccgctgcagacagagggaaccac

SEQ ID NO: 3220 - DNA, 45 bp, Artificial sequence
  Synthetic oligonucleotide probe
agtggcaacacaggtcctgcctggggatcaggtctgctctgcacc

SEQ ID NO: 3221 - DNA, 45 bp, Artificial sequence
  Synthetic oligonucleotide probe
caccccaccttgctgcctggagccgcccacctgacaacctctcat

SEQ ID NO: 3222 - DNA, 45 bp, Artificial sequence
  Synthetic oligonucleotide probe
ccgcccatcgccccacaacgccagccgggtgaacgttggcaggtc

SEQ ID NO: 3223 - DNA, 45 bp, Artificial sequence
  Synthetic oligonucleotide probe
tatacaggctggggaagtttgcccttgcgtggggtggtgatggag

SEQ ID NO: 3224 - DNA, 45 bp, Artificial sequence
  Synthetic oligonucleotide probe
gatggaggaggctcagcaagtcttctggactgtgaacctgtgtct

SEQ ID NO: 3225 - DNA, 45 bp, Artificial sequence
  Synthetic oligonucleotide probe
aagtcttctggactgtgaacctgtgtctgccactgtgtgctgggt

SEQ ID NO: 3226 - DNA, 45 bp, Artificial sequence
  Synthetic oligonucleotide probe
ggtggtcatctttcccaccaggctgtggcctctgcaaccttcaag

SEQ ID NO: 3227 - DNA, 49 bp, Artificial sequence
  Synthetic oligonucleotide probe
ttcctggccacaggttccatgtccttatatggactcatctttgcctatt

SEQ ID NO: 3228 - DNA, 55 bp, Artificial sequence
  Synthetic oligonucleotide probe
cttatatggactcatctttgcctattgcgacacacactcagtgaacacctactac

SEQ ID NO: 3229 - DNA, 45 bp, Artificial sequence
  Synthetic oligonucleotide probe
acactcagtgaacacctactacgcgctgcaaagagccccgcaggc

SEQ ID NO: 3230 - DNA, 45 bp, Artificial sequence
  Synthetic oligonucleotide probe
ctctaggctgagccgaatgcccctctgtggtcccacgccactgat

SEQ ID NO: 3231 - DNA, 45 bp, Artificial sequence
  Synthetic oligonucleotide probe
gtcttgtgtgctactcagtggacagacccaaggcaagaaagggtg

SEQ ID NO: 3232 - DNA, 45 bp, Artificial sequence
  Synthetic oligonucleotide probe
atggagtcttggtccccagagtcccccagcggcctccagatggtc

SEQ ID NO: 3233 - DNA, 48 bp, Artificial sequence
  Synthetic oligonucleotide probe
taacgccccaggccttgtcttggctgggcgtgactgttaccctcaaaa

SEQ ID NO: 3234 - DNA, 45 bp, Artificial sequence
  Synthetic oligonucleotide probe
cttccttcccagggctgcggctgggtaggtttgtagccttcatca

SEQ ID NO: 3235 - DNA, 45 bp, Artificial sequence
  Synthetic oligonucleotide probe
agccactggaccgctggcccctgccctgtcctggggagtgtggtc

SEQ ID NO: 3236 - DNA, 45 bp, Artificial sequence
  Synthetic oligonucleotide probe
cctgtcctggggagtgtggtcctgcgacttctaagtggccgcaag

SEQ ID NO: 3237 - DNA, 45 bp, Artificial sequence
  Synthetic oligonucleotide probe
gagtgtggtcctgcgacttctaagtggccgcaagccacctgactc

SEQ ID NO: 3238 - DNA, 45 bp, Artificial sequence
  Synthetic oligonucleotide probe
ctgctttcagggcagttgctctgaagtcggcaagggggagtgact

SEQ ID NO: 3239 - DNA, 45 bp, Artificial sequence
  Synthetic oligonucleotide probe
ccacctgggcgctcagtgcccaagagatgtccacacctaggatgt

SEQ ID NO: 3240 - DNA, 45 bp, Artificial sequence
  Synthetic oligonucleotide probe
ggggccaatcagcgtgcgccgttccgaaagttgccttttatggct

SEQ ID NO: 3241 - DNA, 47 bp, Artificial sequence
  Synthetic oligonucleotide probe
aaagttgccttttatggctcgagcggccgcggcggcgccctataaaa

SEQ ID NO: 3242 - DNA, 45 bp, Artificial sequence
  Synthetic oligonucleotide probe
tataaaacccagcggcgcgacgcgccaccaccgccgagaccgcgt

SEQ ID NO: 3243 - DNA, 45 bp, Artificial sequence
  Synthetic oligonucleotide probe
gcgagcacagagcctcgcctttgccgatccgccgcccgtccacac

SEQ ID NO: 3244 - DNA, 45 bp, Artificial sequence
  Synthetic oligonucleotide probe
gcctttgccgatccgccgcccgtccacacccgccgccaggtaagc

SEQ ID NO: 3245 - DNA, 45 bp, Artificial sequence
  Synthetic oligonucleotide probe
caggtaagcccggccagccgaccggggcaggcggctcacggcccg

SEQ ID NO: 3246 - DNA, 45 bp, Artificial sequence
  Synthetic oligonucleotide probe
ctcacggcccggccgcaggcggccgcggccccttcgcccgtgcag

SEQ ID NO: 3247 - DNA, 45 bp, Artificial sequence
  Synthetic oligonucleotide probe
gaccgccgtggggggcgcgggagaagcccctgggcctccggagat

SEQ ID NO: 3248 - DNA, 45 bp, Artificial sequence
  Synthetic oligonucleotide probe
cttgccaatggggatcgcagggtgggcgcggcggagcccccgcca

SEQ ID NO: 3249 - DNA, 45 bp, Artificial sequence
  Synthetic oligonucleotide probe
gagcccccgccaggcccggtgggggctggggcgccattgcgcgtg

SEQ ID NO: 3250 - DNA, 45 bp, Artificial sequence
  Synthetic oligonucleotide probe
ctggggcgccattgcgcgtgcgcgctggtcctttgggcgctaact

SEQ ID NO: 3251 - DNA, 45 bp, Artificial sequence
  Synthetic oligonucleotide probe
gctaactgcgtgcgcgctgggaattggcgctaattgcgcgtgcgc

SEQ ID NO: 3252 - DNA, 45 bp, Artificial sequence
  Synthetic oligonucleotide probe
aattggcgctaattgcgcgtgcgcgctgggactcaaggcgctaac

SEQ ID NO: 3253 - DNA, 45 bp, Artificial sequence
  Synthetic oligonucleotide probe
acttcctgcccgagccgctggccgcccgagggtgtggccgctgcg

SEQ ID NO: 3254 - DNA, 45 bp, Artificial sequence
  Synthetic oligonucleotide probe
ctgcgtgcgcgcgcgccgacccggcgctgtttgaaccgggcggag

SEQ ID NO: 3255 - DNA, 46 bp, Artificial sequence
  Synthetic oligonucleotide probe
tttgaaccgggcggaggcggggctggcgcccggttgggagggggtt

SEQ ID NO: 3256 - DNA, 45 bp, Artificial sequence
  Synthetic oligonucleotide probe
gctggcgcccggttgggagggggttggggcctggcttcctgccgc

SEQ ID NO: 3257 - DNA, 45 bp, Artificial sequence
  Synthetic oligonucleotide probe
ccgcggggacgcctccgaccagtgtttgccttttatggtaataac

SEQ ID NO: 3258 - DNA, 45 bp, Artificial sequence
  Synthetic oligonucleotide probe
gtttgccttttatggtaataacgcggccggcccggcttcctttgt

SEQ ID NO: 3259 - DNA, 45 bp, Artificial sequence
  Synthetic oligonucleotide probe
gcttcctttgtccccaatctgggcgcgcgccggcgccccctggcg

SEQ ID NO: 3260 - DNA, 45 bp, Artificial sequence
  Synthetic oligonucleotide probe
gcgctcgtcgtcgacaacggctccggcatgtgcaaggccggcttc

SEQ ID NO: 3261 - DNA, 45 bp, Artificial sequence
  Synthetic oligonucleotide probe
cttcgcgggcgacgatgccccccgggccgtcttcccctccatcgt

SEQ ID NO: 3262 - DNA, 45 bp, Artificial sequence
  Synthetic oligonucleotide probe
gcgggaggcaagggcgctttctctgcacaggagcctcccggtttc

SEQ ID NO: 3263 - DNA, 45 bp, Artificial sequence
  Synthetic oligonucleotide probe
aactgggacgacatggagaaaatctggcaccacaccttctacaat

SEQ ID NO: 3264 - DNA, 45 bp, Artificial sequence
  Synthetic oligonucleotide probe
aaccgcgagaagatgacccaggtgagtggcccgctacctcttctg

SEQ ID NO: 3265 - DNA, 47 bp, Artificial sequence
  Synthetic oligonucleotide probe
tttctcactggttctctcttctgccgttttccgtaggactctcttct

SEQ ID NO: 3266 - DNA, 45 bp, Artificial sequence
  Synthetic oligonucleotide probe
catgaggctggtgtaaagcggccttggagtgtgtattaagtaggt

SEQ ID NO: 3267 - DNA, 48 bp, Artificial sequence
  Synthetic oligonucleotide probe
gagtgtgtattaagtaggtgcacagtaggtctgaacagactccccatc

SEQ ID NO: 3268 - DNA, 45 bp, Artificial sequence
  Synthetic oligonucleotide probe
agtaggtctgaacagactccccatcccaagaccccagcacactta

SEQ ID NO: 3269 - DNA, 45 bp, Artificial sequence
  Synthetic oligonucleotide probe
aagaccccagcacacttagccgtgttctttgcactttctgcatgt

SEQ ID NO: 3270 - DNA, 45 bp, Artificial sequence
  Synthetic oligonucleotide probe
gtgttctttgcactttctgcatgtcccccgtctggcctggctgtc

SEQ ID NO: 3271 - DNA, 45 bp, Artificial sequence
  Synthetic oligonucleotide probe
ggcttccccagtgtgacatggtgtatctctgccttacagatcatg

SEQ ID NO: 3272 - DNA, 45 bp, Artificial sequence
  Synthetic oligonucleotide probe
cacactgtgcccatctacgaggggtatgccctcccccatgccatc

SEQ ID NO: 3273 - DNA, 45 bp, Artificial sequence
  Synthetic oligonucleotide probe
ggtgagtggagactgtctcccggctctgcctgacatgagggttac

SEQ ID NO: 3274 - DNA, 45 bp, Artificial sequence
  Synthetic oligonucleotide probe
catggagtcctgtggcatccacgaaactaccttcaactccatcat

SEQ ID NO: 3275 - DNA, 45 bp, Artificial sequence
  Synthetic oligonucleotide probe
cagaaggagatcactgccctggcacccagcacaatgaagatcaag

SEQ ID NO: 3276 - DNA, 45 bp, Artificial sequence
  Synthetic oligonucleotide probe
ctcactgcctgtccccttccctcctcagatcattgctcctcctga

SEQ ID NO: 3277 - DNA, 45 bp, Artificial sequence
  Synthetic oligonucleotide probe
accttccagcagatgtggatcagcaagcaggagtatgacgagtcc

SEQ ID NO: 3278 - DNA, 45 bp, Artificial sequence
  Synthetic oligonucleotide probe
ccctccatcgtccaccgcaaatgcttctaggcggactatgactta

SEQ ID NO: 3279 - DNA, 57 bp, Artificial sequence
  Synthetic oligonucleotide probe
tatgacttagttgcgttacaccctttcttgacaaaacctaacttgcgcagaaaacaa

SEQ ID NO: 3280 - DNA, 45 bp, Artificial sequence
  Synthetic oligonucleotide probe
agcgagcatcccccaaagttcacaatgtggccgaggactttgatt

SEQ ID NO: 3281 - DNA, 45 bp, Artificial sequence
  Synthetic oligonucleotide probe
cttgccatcctaaaagccaccccacttctctctaaggagaatggc

SEQ ID NO: 3282 - DNA, 45 bp, Artificial sequence
  Synthetic oligonucleotide probe
cttgagatgtatgaaggcttttggtctccctgggagtgggtggag

SEQ ID NO: 3283 - DNA, 45 bp, Artificial sequence
  Synthetic oligonucleotide probe
aagtgtgactttgtggtgtggctgggttgggggcagcagagggtg

SEQ ID NO: 3284 - DNA, 45 bp, Artificial sequence
  Synthetic oligonucleotide probe
tgaaccctgcaaaagggtggggcagtgggggccaacttgtcctta

SEQ ID NO: 3285 - DNA, 45 bp, Artificial sequence
  Synthetic oligonucleotide probe
gtgggggccaacttgtccttacccagagtgcaggtgtgtggagat

SEQ ID NO: 3286 - DNA, 45 bp, Artificial sequence
  Synthetic oligonucleotide probe
aggtgtgtggagatccctcctgccttgacattgagcagccttaga

SEQ ID NO: 3287 - DNA, 45 bp, Artificial sequence
  Synthetic oligonucleotide probe
aggctcaggggtcaggtctctgttcctgcttattggggagttcct

SEQ ID NO: 3288 - DNA, 45 bp, Artificial sequence
  Synthetic oligonucleotide probe
agatgcttgaggaggtgggaagggactatttgggggtgtctggct

SEQ ID NO: 3289 - DNA, 45 bp, Artificial sequence
  Synthetic oligonucleotide probe
gtcagcctggcccaggctcccataggcttaggagaggccgcaatt

SEQ ID NO: 3290 - DNA, 45 bp, Artificial sequence
  Synthetic oligonucleotide probe
ataggcttaggagaggccgcaattcctacctgttcatccagacag

SEQ ID NO: 3291 - DNA, 45 bp, Artificial sequence
  Synthetic oligonucleotide probe
ctacctgttcatccagacagagggggacctggaatcaaagtcaag

SEQ ID NO: 3292 - DNA, 45 bp, Artificial sequence
  Synthetic oligonucleotide probe
attctgccttgtgactggagactgggcgccatcccgtggcctctg

SEQ ID NO: 3293 - DNA, 45 bp, Artificial sequence
  Synthetic oligonucleotide probe
agtttgttcgtgacccatgctgcagagggagatacccaggctcct

SEQ ID NO: 3294 - DNA, 46 bp, Artificial sequence
  Synthetic oligonucleotide probe
ctgagttaaatactctcgcaagaagaaaccaagcctggcctgcctt

SEQ ID NO: 3295 - DNA, 47 bp, Artificial sequence
  Synthetic oligonucleotide probe
tttaccccaaacaccacctggtgcatagcagttgttctggaaatgat

SEQ ID NO: 3296 - DNA, 47 bp, Artificial sequence
  Synthetic oligonucleotide probe
atttctgcagtggtgagccctgggccaccttgggccacttaatcatt

SEQ ID NO: 3297 - DNA, 47 bp, Artificial sequence
  Synthetic oligonucleotide probe
cacttaatcattcaacccccattcattgagtgaccactctacggtgg

SEQ ID NO: 3298 - DNA, 45 bp, Artificial sequence
  Synthetic oligonucleotide probe
attcattgagtgaccactctacggtgggggaggctactgagatga

SEQ ID NO: 3299 - DNA, 48 bp, Artificial sequence
  Synthetic oligonucleotide probe
atttgtgccagatagtgcgggtatagaggagaaccaaccagatgtgtt

SEQ ID NO: 3300 - DNA, 45 bp, Artificial sequence
  Synthetic oligonucleotide probe
cgtgtcctcaccaggcacccagtttaatggggaagacatcacaag

SEQ ID NO: 3301 - DNA, 53 bp, Artificial sequence
  Synthetic oligonucleotide probe
gtgatgttcattatgtcgattgtggtggtggtcttgcaggtgtagacatactt

SEQ ID NO: 3302 - DNA, 45 bp, Artificial sequence
  Synthetic oligonucleotide probe
cttctcaaaatcacccatctctgtctgggcatctcctgcagtgca

SEQ ID NO: 3303 - DNA, 60 bp, Artificial sequence
  Synthetic oligonucleotide probe
gttttgaaccctgtaatgtctgttattcctttttgctaccttcagtaaattttagtgccc

SEQ ID NO: 3304 - DNA, 60 bp, Artificial sequence
  Synthetic oligonucleotide probe
tcacgtttaaaaagtttattcctcttaaggggtgcctagttaaagatttgtttaagaaga

SEQ ID NO: 3305 - DNA, 60 bp, Artificial sequence
  Synthetic oligonucleotide probe
tctaatagtctagtggaaagactctaataagagtcagatactagaaaatagttaacacag

SEQ ID NO: 3306 - DNA, 47 bp, Artificial sequence
  Synthetic oligonucleotide probe
aacattagtagttcctttcttggccctcactgtccttccagtgttgg

SEQ ID NO: 3307 - DNA, 46 bp, Artificial sequence
  Synthetic oligonucleotide probe
atacttcttgctcccaagcatcacaggcgctgtcctgtcttccata

SEQ ID NO: 3308 - DNA, 45 bp, Artificial sequence
  Synthetic oligonucleotide probe
gcaacgcgtcagtcgcaggttcgccgaggtttcttggtgaaagat

SEQ ID NO: 3309 - DNA, 56 bp, Artificial sequence
  Synthetic oligonucleotide probe
tttcacctctgagtcatccatatgtagcccagaagtagtagtagcctggaaaatag

SEQ ID NO: 3310 - DNA, 60 bp, Artificial sequence
  Synthetic oligonucleotide probe
tttccaaatcagagttagttgccatgttggaggtaagaaaacgtaaccactttaaaatgt

SEQ ID NO: 3311 - DNA, 49 bp, Artificial sequence
  Synthetic oligonucleotide probe
ttgaaggaccgaaaatggcagatattcaaaacgtcagcaaccaaaggca

SEQ ID NO: 3312 - DNA, 48 bp, Artificial sequence
  Synthetic oligonucleotide probe
atgacttcctcagagatggcaaattcacttgggttacctgccttgaag

SEQ ID NO: 3313 - DNA, 52 bp, Artificial sequence
  Synthetic oligonucleotide probe
cttttgcacttgctgatccgtctgcttggaatactattctccagcatctttg

SEQ ID NO: 3314 - DNA, 45 bp, Artificial sequence
  Synthetic oligonucleotide probe
attctccagcatctttgcatggctgccttcctgacgtgtttcttc

SEQ ID NO: 3315 - DNA, 45 bp, Artificial sequence
  Synthetic oligonucleotide probe
agtgttggcctctggcctcttcccctcacatttatgttcattctc

SEQ ID NO: 3316 - DNA, 46 bp, Artificial sequence
  Synthetic oligonucleotide probe
tatattcattctctgctgctttctcccttcacccgtgggactctca

SEQ ID NO: 3317 - DNA, 60 bp, Artificial sequence
  Synthetic oligonucleotide probe
attgctaaaaacagggtgaatttctttcacttaagttggaaaaccagcctctaaaaaatt

SEQ ID NO: 3318 - DNA, 60 bp, Artificial sequence
  Synthetic oligonucleotide probe
tatatccaccagaaacagtgaatcattaaggcattgattctaacatgtgtgggacagaat

SEQ ID NO: 3319 - DNA, 60 bp, Artificial sequence
  Synthetic oligonucleotide probe
ccagaagccaatgactaaggattagtgatctgaatcatagcaagatcttttgcaaaatga

SEQ ID NO: 3320 - DNA, 60 bp, Artificial sequence
  Synthetic oligonucleotide probe
gggtatggaactatatataaatgtgatcttaaatgtgtaaatgtatttactaaataaact

SEQ ID NO: 3321 - DNA, 51 bp, Artificial sequence
  Synthetic oligonucleotide probe
aaatgaaactttattcttggttcttggcccgctgattgagggaactgcatt

SEQ ID NO: 3322 - DNA, 55 bp, Artificial sequence
  Synthetic oligonucleotide probe
gaaaggactttgtcaagtcacacctattctgttgaactttcccaaggttctctag

SEQ ID NO: 3323 - DNA, 45 bp, Artificial sequence
  Synthetic oligonucleotide probe
aatcactgaagatcggcgagggaggacagggggttcatcatgggt

SEQ ID NO: 3324 - DNA, 60 bp, Artificial sequence
  Synthetic oligonucleotide probe
ggcatgaatattgttttgatggttaacttcactgacttatctgtaagtgtcattttatag

SEQ ID NO: 3325 - DNA, 60 bp, Artificial sequence
  Synthetic oligonucleotide probe
ttttcctaatgtatctctattcctactgcctaatcactcacttaaagttagatgcccttg

SEQ ID NO: 3326 - DNA, 60 bp, Artificial sequence
  Synthetic oligonucleotide probe
taaatggagccacctagtttaaaatgaggtaaaattgggaactatttccttagagcatcc

SEQ ID NO: 3327 - DNA, 56 bp, Artificial sequence
  Synthetic oligonucleotide probe
attagaaaggaccctccatttagttcttgtcagtctctcctctctgaaacacattg

SEQ ID NO: 3328 - DNA, 60 bp, Artificial sequence
  Synthetic oligonucleotide probe
ttatcatataaagtattgcttaaaaggaatggattattgacttcagtttacaatttttga

SEQ ID NO: 3329 - DNA, 60 bp, Artificial sequence
  Synthetic oligonucleotide probe
taccttcagtaaattttagtgcccttagtttttgcttctcaaaatcacccatctctgtct

SEQ ID NO: 3330 - DNA, 60 bp, Artificial sequence
  Synthetic oligonucleotide probe
tgtcagtgattaatttcatgactgttaaataaaatcacgtttaaaaagtttattcctctt

SEQ ID NO: 3331 - DNA, 60 bp, Artificial sequence
  Synthetic oligonucleotide probe
gacttttgatttcttgaactactgacttaatggcttccaagttataaattgcagacttaa

SEQ ID NO: 3332 - DNA, 60 bp, Artificial sequence
  Synthetic oligonucleotide probe
accctagtaatatataatgagatgctatgtttggaaaagtaaataattcccaactctaca

SEQ ID NO: 3333 - DNA, 48 bp, Artificial sequence
  Synthetic oligonucleotide probe
ctcaagcgttttctctcactggtcttcaggtgcatctgtcttctcaac

SEQ ID NO: 3334 - DNA, 60 bp, Artificial sequence
  Synthetic oligonucleotide probe
tctatttgtatggaattcttattcaaatacagttctattaaagagtatactcctattgga

SEQ ID NO: 3335 - DNA, 47 bp, Artificial sequence
  Synthetic oligonucleotide probe
ttgaatcctagggcatgaagttgccccaaagttcagcacttggttaa

SEQ ID NO: 3336 - DNA, 45 bp, Artificial sequence
  Synthetic oligonucleotide probe
acttgactcactttggatcttcatctgtaggggtggatccggcct

SEQ ID NO: 3337 - DNA, 49 bp, Artificial sequence
  Synthetic oligonucleotide probe
agagcctgggttcgagttctttacccttatcatgaagttttccctcatc

SEQ ID NO: 3338 - DNA, 52 bp, Artificial sequence
  Synthetic oligonucleotide probe
ataaccgccttcagttttgttccgcctctcttctacctgtaaatggtagaaa

SEQ ID NO: 3339 - DNA, 45 bp, Artificial sequence
  Synthetic oligonucleotide probe
cgctcgagggagccgcggccgagggctggggtgcagaggaggaga

SEQ ID NO: 3340 - DNA, 53 bp, Artificial sequence
  Synthetic oligonucleotide probe
attttagtggtgtttgcaaataaacaggacatggaacaggccatgacttcctc

SEQ ID NO: 3341 - DNA, 53 bp, Artificial sequence
  Synthetic oligonucleotide probe
aaattcacttgggttacctgccttgaaggaccgaaaatggcagatattcaaaa

SEQ ID NO: 3342 - DNA, 60 bp, Artificial sequence
  Synthetic oligonucleotide probe
ttaaatttatggactaaaacgaaagaggctagcctctaagaaagaagagcgttttgaacc

SEQ ID NO: 3343 - DNA, 60 bp, Artificial sequence
  Synthetic oligonucleotide probe
tttagaatattgtgttaaggaaacagatttaaacagaaatttttgtataaagaccctgtc

SEQ ID NO: 3344 - DNA, 60 bp, Artificial sequence
  Synthetic oligonucleotide probe
tcttaggtaattatattgattacttttaaagatctgagttgcagagactgagtgttgaag

SEQ ID NO: 3345 - DNA, 60 bp, Artificial sequence
  Synthetic oligonucleotide probe
tttactgttggtgaacattgtgattacactcctacctaattctaagggagacatcatgaa

SEQ ID NO: 3346 - DNA, 54 bp, Artificial sequence
  Synthetic oligonucleotide probe
ccctcacatttatgttcattctccgggcttatattcattctctgctgctttctc

SEQ ID NO: 3347 - DNA, 60 bp, Artificial sequence
  Synthetic oligonucleotide probe
cctgcatgacacaatagtaacataactaaggacatagtaacataactaattacttgtttg

SEQ ID NO: 3348 - DNA, 45 bp, Artificial sequence
  Synthetic oligonucleotide probe
ggcatgtagccgctggccatcttgaatcctagggcatgaagttgc

SEQ ID NO: 3349 - DNA, 50 bp, Artificial sequence
  Synthetic oligonucleotide probe
tcgtttctcaccctccaaatgaaggtgcagattctttggcttggttaaat

SEQ ID NO: 3350 - DNA, 45 bp, Artificial sequence
  Synthetic oligonucleotide probe
attctcacaagcatcaggtaacaccctcgccccgctagaacccaa

SEQ ID NO: 3351 - DNA, 60 bp, Artificial sequence
  Synthetic oligonucleotide probe
ttggcatttgtctgctaatctgctgtagcgtttcatgtaataatacgggtatttctagtc

SEQ ID NO: 3352 - DNA, 60 bp, Artificial sequence
  Synthetic oligonucleotide probe
atctactcattagataatcacctccttgaggattgagactagtttcacctctgagtcatc

SEQ ID NO: 3353 - DNA, 60 bp, Artificial sequence
  Synthetic oligonucleotide probe
gtcttgcacatataaacgatgttttttactgttggtgaacattgtgattacactcctacc

SEQ ID NO: 3354 - DNA, 60 bp, Artificial sequence
  Synthetic oligonucleotide probe
tgataaagtttgtaaactgctagtatgaacataacattgataacactttttccatcaact

SEQ ID NO: 3355 - DNA, 60 bp, Artificial sequence
  Synthetic oligonucleotide probe
tttcgaacacttttaactactctattatgaggggagtttaatataataggatttccattg

SEQ ID NO: 3356 - DNA, 55 bp, Artificial sequence
  Synthetic oligonucleotide probe
ccttcttgctcattctccagcacccattcctactttagtctctttgaaatctttt

SEQ ID NO: 3357 - DNA, 60 bp, Artificial sequence
  Synthetic oligonucleotide probe
aaactatatgattattggcatatactgactgactgcaatatttgtagtaaatagggaaaa

SEQ ID NO: 3358 - DNA, 60 bp, Artificial sequence
  Synthetic oligonucleotide probe
tgctgtaactcaattagataggatattttgaaggtggaatgtattagtctacacatacca

SEQ ID NO: 3359 - DNA, 45 bp, Artificial sequence
  Synthetic oligonucleotide probe
caaaaaatgggaagtaaggtcctggcaggcagacccggcatgtag

SEQ ID NO: 3360 - DNA, 60 bp, Artificial sequence
  Synthetic oligonucleotide probe
tggcatttcagaatatgttcatagttgaaacagtaggatagatatttgtcatcttgacaa

SEQ ID NO: 3361 - DNA, 54 bp, Artificial sequence
  Synthetic oligonucleotide probe
atcttgacaagtagccctttgcaatttatacttgagttcactcctggtcaatgg

SEQ ID NO: 3362 - DNA, 60 bp, Artificial sequence
  Synthetic oligonucleotide probe
agtgaggggatcatgctaaaatattcctattctgctgattagaaaatgagattcccaaag

SEQ ID NO: 3363 - DNA, 48 bp, Artificial sequence
  Synthetic oligonucleotide probe
aggattacattgtcccactatcctccttactggccccttggtttttag

SEQ ID NO: 3364 - DNA, 60 bp, Artificial sequence
  Synthetic oligonucleotide probe
tcatgtaataatacgggtatttctagtcggcaaatgaaactttattcttggttcttggcc

SEQ ID NO: 3365 - DNA, 49 bp, Artificial sequence
  Synthetic oligonucleotide probe
caagtgagggtgcacattctttaactcgtttctcaccctccaaatgaag

SEQ ID NO: 3366 - DNA, 56 bp, Artificial sequence
  Synthetic oligonucleotide probe
gtgttgcttatgttgttttatggccagtttggcatttgtctgctaatctgctgtag

SEQ ID NO: 3367 - DNA, 60 bp, Artificial sequence
  Synthetic oligonucleotide probe
tccaaagattagactcagtatgagagtaggtgaggaacatagtttgtgtaatataatctt

SEQ ID NO: 3368 - DNA, 57 bp, Artificial sequence
  Synthetic oligonucleotide probe
tagaaggattcaagttcagagaaatatgtatttctgggttactggcacaatgctggc

SEQ ID NO: 3369 - DNA, 60 bp, Artificial sequence
  Synthetic oligonucleotide probe
gaactatttccttagagcatccattgagttaaaacttaaggaagcccagttttccagata

SEQ ID NO: 3370 - DNA, 60 bp, Artificial sequence
  Synthetic oligonucleotide probe
tttaatcttctctaatggctctggatgggaaaaggactgtgctttttatcctacacaata

SEQ ID NO: 3371 - DNA, 50 bp, Artificial sequence
  Synthetic oligonucleotide probe
gacaggttatgatgtcttcactgtatggacgtgaacccagggttctaata

SEQ ID NO: 3372 - DNA, 60 bp, Artificial sequence
  Synthetic oligonucleotide probe
acctcaattttaatcaattattactgtcttacaaaaatattctccaacagtcttactgac

SEQ ID NO: 3373 - DNA, 57 bp, Artificial sequence
  Synthetic oligonucleotide probe
cttgttctggtttacggccgggttgggctgtttataggtttaagttactaaatctta

SEQ ID NO: 3374 - DNA, 60 bp, Artificial sequence
  Synthetic oligonucleotide probe
agacaactgcacaggtatactaccagcgtttggatattgatatatacatggcaaatctga

SEQ ID NO: 3375 - DNA, 49 bp, Artificial sequence
  Synthetic oligonucleotide probe
attctttggcttggttaaatccctccacagttttctggggagcatactt

SEQ ID NO: 3376 - DNA, 60 bp, Artificial sequence
  Synthetic oligonucleotide probe
tcaatacatcttattcactgaagttaataagatcatatattggctaactgatcaaattca

SEQ ID NO: 3377 - DNA, 59 bp, Artificial sequence
  Synthetic oligonucleotide probe
atttatgtagtagacagttgtgaccgagaccgaattggcatttccaaatcagagttagt

SEQ ID NO: 3378 - DNA, 45 bp, Artificial sequence
  Synthetic oligonucleotide probe
acctgccctttgaccacccagccatgaccttattacaagtgagtt

SEQ ID NO: 3379 - DNA, 51 bp, Artificial sequence
  Synthetic oligonucleotide probe
taattcagtccattcttctcccctgaaatgaagactacatcacctctctcc

SEQ ID NO: 3380 - DNA, 60 bp, Artificial sequence
  Synthetic oligonucleotide probe
gcagagcatactatttcgtcttaaatggtataaaatctcaaccaataatgtgattcaaca

SEQ ID NO: 3381 - DNA, 51 bp, Artificial sequence
  Synthetic oligonucleotide probe
attttgggcttgacatggcaacagtgaatgtttgatgaccgtcagtagttg

SEQ ID NO: 3382 - DNA, 55 bp, Artificial sequence
  Synthetic oligonucleotide probe
aaagttcagcacttggttaagcctgatccctctggtttatcacaaagaataggat

SEQ ID NO: 3383 - DNA, 60 bp, Artificial sequence
  Synthetic oligonucleotide probe
tggatattgatatatacatggcaaatctgaatattgttttatgagaggcctggcaatggg

SEQ ID NO: 3384 - DNA, 60 bp, Artificial sequence
  Synthetic oligonucleotide probe
tctttaggaagtcacttttaattcatcaataaatatcatgttatgttaagtatgggccaa

SEQ ID NO: 3385 - DNA, 60 bp, Artificial sequence
  Synthetic oligonucleotide probe
ttgactcataaactatactatatattcccaaaaatgtcagtattgacaacacagtctaac

SEQ ID NO: 3386 - DNA, 45 bp, Artificial sequence
  Synthetic oligonucleotide probe
gtagcagcgagcagcagagtccgcacgctccggcgaggggcagaa

SEQ ID NO: 3387 - DNA, 45 bp, Artificial sequence
  Synthetic oligonucleotide probe
aggggcagaagagcgcgagggagcgcggggcagcagaagcgagag

SEQ ID NO: 3388 - DNA, 45 bp, Artificial sequence
  Synthetic oligonucleotide probe
gccatgctgaaggcggaggagacctgcgcgccctcggtgtcctac

SEQ ID NO: 3389 - DNA, 45 bp, Artificial sequence
  Synthetic oligonucleotide probe
ggtgtcctacttcaaatgtgtgcagaaggaggtcctgccgtccat

SEQ ID NO: 3390 - DNA, 45 bp, Artificial sequence
  Synthetic oligonucleotide probe
ctggatgctggaggtgcggggcttcgggcggctctcttaagactt

SEQ ID NO: 3391 - DNA, 45 bp, Artificial sequence
  Synthetic oligonucleotide probe
ccaatgggcccgagggtgcgggctggcaggctgggtgcgctttgt

SEQ ID NO: 3392 - DNA, 60 bp, Artificial sequence
  Synthetic oligonucleotide probe
ctcgtgccagtattatgcgccatctttgctcttttattgcaaagcaaaagtgtttattaa

SEQ ID NO: 3393 - DNA, 45 bp, Artificial sequence
  Synthetic oligonucleotide probe
ctttgttcaagcagcgagtcccggggcgccccgaacgggcagcct

SEQ ID NO: 3394 - DNA, 45 bp, Artificial sequence
  Synthetic oligonucleotide probe
gcttgatccccgtctgcagggatatcggcttggaggaccttctcc

SEQ ID NO: 3395 - DNA, 45 bp, Artificial sequence
  Synthetic oligonucleotide probe
gagcctgtaacgaactcccaacccccggcctgggtaaagggtcgc

SEQ ID NO: 3396 - DNA, 45 bp, Artificial sequence
  Synthetic oligonucleotide probe
gcctgggacgccacctttgtgtctcgcaggcgcggcgcccaaccc

SEQ ID NO: 3397 - DNA, 45 bp, Artificial sequence
  Synthetic oligonucleotide probe
aaccccgcggcccgttccgcggccccgcaccccagttggtgtcga

SEQ ID NO: 3398 - DNA, 45 bp, Artificial sequence
  Synthetic oligonucleotide probe
gacccctcggcgccctccagacctggcggccctgccaagcgcgat

SEQ ID NO: 3399 - DNA, 45 bp, Artificial sequence
  Synthetic oligonucleotide probe
gaacagaagtgcgaggaggaggtcttcccgctggccatgaactac

SEQ ID NO: 3400 - DNA, 45 bp, Artificial sequence
  Synthetic oligonucleotide probe
acttgcatgttcgtggcctctaagatgaaggagaccatccccctg

SEQ ID NO: 3401 - DNA, 45 bp, Artificial sequence
  Synthetic oligonucleotide probe
gaaggtgcaggcggtggcggccggcccgcctctgacatatctgct

SEQ ID NO: 3402 - DNA, 45 bp, Artificial sequence
  Synthetic oligonucleotide probe
gcctctgacatatctgctcctccgagggagggcggccccgccgcc

SEQ ID NO: 3403 - DNA, 45 bp, Artificial sequence
  Synthetic oligonucleotide probe
ggcgtccctgtccggggagcgggcgggatcctagccgccctcgtc

SEQ ID NO: 3404 - DNA, 45 bp, Artificial sequence
  Synthetic oligonucleotide probe
gtcccgccgccctgtgtgcgcttgcctgcgactcccaccgcgttc

SEQ ID NO: 3405 - DNA, 45 bp, Artificial sequence
  Synthetic oligonucleotide probe
ctgcgactcccaccgcgttcgcgccccgcggtgtggccgaaaagt

SEQ ID NO: 3406 - DNA, 45 bp, Artificial sequence
  Synthetic oligonucleotide probe
gtgtggccgaaaagtgggcggcgcgcgccctccagcggctgcacg

SEQ ID NO: 3407 - DNA, 45 bp, Artificial sequence
  Synthetic oligonucleotide probe
aaaagtgggcggcgcgcgccctccagcggctgcacgaggagcgcc

SEQ ID NO: 3408 - DNA, 45 bp, Artificial sequence
  Synthetic oligonucleotide probe
gctgcacgaggagcgccgcgctcggcgctgagcctccagttccag

SEQ ID NO: 3409 - DNA, 45 bp, Artificial sequence
  Synthetic oligonucleotide probe
caggtggtgggaggtctttttgtttccacttgcagagtcttttca

SEQ ID NO: 3410 - DNA, 45 bp, Artificial sequence
  Synthetic oligonucleotide probe
tccaacatccaggaccgcacgagacgcaggggccagtgctctgag

SEQ ID NO: 3411 - DNA, 45 bp, Artificial sequence
  Synthetic oligonucleotide probe
attgaacacttcctctccaaaatgccagaggcggaggagaacaaa

SEQ ID NO: 3412 - DNA, 45 bp, Artificial sequence
  Synthetic oligonucleotide probe
atcatccgcaaacacgcgcagaccttcgttgccctctgtgccaca

SEQ ID NO: 3413 - DNA, 45 bp, Artificial sequence
  Synthetic oligonucleotide probe
ccggcagcccccggcctccccttgagagccggctccttaggtgac

SEQ ID NO: 3414 - DNA, 45 bp, Artificial sequence
  Synthetic oligonucleotide probe
cttcttgctctccacctgggtgctgtctgggaagatgtccccaga

SEQ ID NO: 3415 - DNA, 45 bp, Artificial sequence
  Synthetic oligonucleotide probe
agcagaggccctggattgtttgtcgcgctggatggagggagattt

SEQ ID NO: 3416 - DNA, 45 bp, Artificial sequence
  Synthetic oligonucleotide probe
ctgcctgtgtcccgttactctggcctcgtccttcaggccaggcag

SEQ ID NO: 3417 - DNA, 45 bp, Artificial sequence
  Synthetic oligonucleotide probe
atgctgaaaggggtttaccttggccacagggccgcctcctttctc

SEQ ID NO: 3418 - DNA, 45 bp, Artificial sequence
  Synthetic oligonucleotide probe
gcaccacgtgctctgggcagccgagtgcaggggtgtccagcagag

SEQ ID NO: 3419 - DNA, 45 bp, Artificial sequence
  Synthetic oligonucleotide probe
agcagaagcacccagtcctcacttcccctggcatggccccagagg

SEQ ID NO: 3420 - DNA, 45 bp, Artificial sequence
  Synthetic oligonucleotide probe
tccttccctggcccaggaggcctggttaccttcatgggggagcat

SEQ ID NO: 3421 - DNA, 45 bp, Artificial sequence
  Synthetic oligonucleotide probe
ctttggtcaagcctcagttgtcacatctgtttgggggctcactct

SEQ ID NO: 3422 - DNA, 45 bp, Artificial sequence
  Synthetic oligonucleotide probe
caccggtagcccgcagccggtattccagaatgggttctggtttag

SEQ ID NO: 3423 - DNA, 45 bp, Artificial sequence
  Synthetic oligonucleotide probe
tcctcagaggagagaggcctccggagactccagacagccttttat

SEQ ID NO: 3424 - DNA, 45 bp, Artificial sequence
  Synthetic oligonucleotide probe
ctggagagaacgtggggcgtggttcttgcacagcctccctacagg

SEQ ID NO: 3425 - DNA, 45 bp, Artificial sequence
  Synthetic oligonucleotide probe
cagattctcgtccttcccactactgcacaccctttgtctgcgaag

SEQ ID NO: 3426 - DNA, 45 bp, Artificial sequence
  Synthetic oligonucleotide probe
agtgactgtggagtccactccagggtgggtcccgagggaggggca

SEQ ID NO: 3427 - DNA, 45 bp, Artificial sequence
  Synthetic oligonucleotide probe
gcaaagtgctccgggtcctgacccgtggccaccccatggaacgta

SEQ ID NO: 3428 - DNA, 45 bp, Artificial sequence
  Synthetic oligonucleotide probe
cccatggaacgtaactgagcagccagtgccttgttcctgctggac

SEQ ID NO: 3429 - DNA, 45 bp, Artificial sequence
  Synthetic oligonucleotide probe
agtgccttgttcctgctggacatctgtggagacaagagtgactta

SEQ ID NO: 3430 - DNA, 50 bp, Artificial sequence
  Synthetic oligonucleotide probe
gacatctgtggagacaagagtgacttacggctgcttaaagtcagaaacag

SEQ ID NO: 3431 - DNA, 45 bp, Artificial sequence
  Synthetic oligonucleotide probe
taaagtcagaaacaggttgaaggaggtggaggcgtgggaaagagt

SEQ ID NO: 3432 - DNA, 45 bp, Artificial sequence
  Synthetic oligonucleotide probe
aaagagtctaggaaggtgtttttgccctccacgtggcaaaggtta

SEQ ID NO: 3433 - DNA, 48 bp, Artificial sequence
  Synthetic oligonucleotide probe
aaggtgtttttgccctccacgtggcaaaggttacatttaaaggtgatg

SEQ ID NO: 3434 - DNA, 47 bp, Artificial sequence
  Synthetic oligonucleotide probe
gttacatttaaaggtgatgctgggtgttctccctgcactaggcattc

SEQ ID NO: 3435 - DNA, 45 bp, Artificial sequence
  Synthetic oligonucleotide probe
cccaggtccccagcaggtgtgcacatgctgcatacactcacgcat

SEQ ID NO: 3436 - DNA, 45 bp, Artificial sequence
  Synthetic oligonucleotide probe
ctgcatacactcacgcatgggggtttcagggcaggtgcgcccttg

SEQ ID NO: 3437 - DNA, 47 bp, Artificial sequence
  Synthetic oligonucleotide probe
ctaattctgggtggctcctaatctaagcacagacagcaccacacact

SEQ ID NO: 3438 - DNA, 51 bp, Artificial sequence
  Synthetic oligonucleotide probe
gtttctgtgtgcggttctgatttgcctcaatgagaaggttttcattcatgg

SEQ ID NO: 3439 - DNA, 45 bp, Artificial sequence
  Synthetic oligonucleotide probe
ctcgccggcggccctctctttaacaaggccgaagttgtttattct

SEQ ID NO: 3440 - DNA, 51 bp, Artificial sequence
  Synthetic oligonucleotide probe
tctctttaacaaggccgaagttgtttattctctcgggatgaagtctcggat

SEQ ID NO: 3441 - DNA, 45 bp, Artificial sequence
  Synthetic oligonucleotide probe
ttattctctcgggatgaagtctcggatgggccgccacacccctgg

SEQ ID NO: 3442 - DNA, 45 bp, Artificial sequence
  Synthetic oligonucleotide probe
gacaaagatgccacactcatccctgccgacgtccggctcccagcc

SEQ ID NO: 3443 - DNA, 45 bp, Artificial sequence
  Synthetic oligonucleotide probe
ggctcccagcccagggcccctggttcctgtgcagaattcctcgtg

SEQ ID NO: 3444 - DNA, 45 bp, Artificial sequence
  Synthetic oligonucleotide probe
gaggaggggaggccggcattccccgccacaaaccaggacgtaatt

SEQ ID NO: 3445 - DNA, 45 bp, Artificial sequence
  Synthetic oligonucleotide probe
cacaaaccaggacgtaattggtggcagggctctctgtggaaagag

SEQ ID NO: 3446 - DNA, 45 bp, Artificial sequence
  Synthetic oligonucleotide probe
ctctctgtggaaagagccagtctgctgtttgtctaggaggtcagt

SEQ ID NO: 3447 - DNA, 45 bp, Artificial sequence
  Synthetic oligonucleotide probe
tttgtctaggaggtcagtcacagaggccccgagacgcccactact

SEQ ID NO: 3448 - DNA, 45 bp, Artificial sequence
  Synthetic oligonucleotide probe
actactgcagcctggcaggcggatgagcccagtatctggcagtga

SEQ ID NO: 3449 - DNA, 45 bp, Artificial sequence
  Synthetic oligonucleotide probe
cagtatctggcagtgaccagagggagttttgtgcagaccacaaag

SEQ ID NO: 3450 - DNA, 45 bp, Artificial sequence
  Synthetic oligonucleotide probe
agttttgtgcagaccacaaaggctgatgggccgccctagattggt

SEQ ID NO: 3451 - DNA, 45 bp, Artificial sequence
  Synthetic oligonucleotide probe
cctcttggaagtgggcccagatgtgcgggacagtccccaggaagc

SEQ ID NO: 3452 - DNA, 45 bp, Artificial sequence
  Synthetic oligonucleotide probe
gactggtgctaggaaccccacacctcttcccttacttgggaagtc

SEQ ID NO: 3453 - DNA, 51 bp, Artificial sequence
  Synthetic oligonucleotide probe
cccagaaaagtgtttttgtcatcggccagaaataggagagttgtgagtaga

SEQ ID NO: 3454 - DNA, 45 bp, Artificial sequence
  Synthetic oligonucleotide probe
tctgtgctctgaaggtcactgtgacagtcatggtcccatggtaag

SEQ ID NO: 3455 - DNA, 45 bp, Artificial sequence
  Synthetic oligonucleotide probe
cagggcctgagccgcagccacaccacagccgccctgaaggctgcc

SEQ ID NO: 3456 - DNA, 48 bp, Artificial sequence
  Synthetic oligonucleotide probe
taggcttcagccatgcgatgtcccttcagaatatgacttgtctgcaat

SEQ ID NO: 3457 - DNA, 48 bp, Artificial sequence
  Synthetic oligonucleotide probe
attcacaaggctcaagatgctaaaaggatgagaaggcagtgatgtccc

SEQ ID NO: 3458 - DNA, 46 bp, Artificial sequence
  Synthetic oligonucleotide probe
ctgtcctgtgtcttcccgtggctttctctttccttggttatgtttg

SEQ ID NO: 3459 - DNA, 45 bp, Artificial sequence
  Synthetic oligonucleotide probe
tctctttccttggttatgtttgagtcaacagtggggctgacgttc

SEQ ID NO: 3460 - DNA, 45 bp, Artificial sequence
  Synthetic oligonucleotide probe
gagtgcttcccttcaggccgggccgcttgctcagagccagcacac

SEQ ID NO: 3461 - DNA, 45 bp, Artificial sequence
  Synthetic oligonucleotide probe
aagttcatttccaatccgccctccatggtggcagcggggagcgtg

SEQ ID NO: 3462 - DNA, 45 bp, Artificial sequence
  Synthetic oligonucleotide probe
aacaacttcctgtcctactaccgcctcacacgcttcctctccaga

SEQ ID NO: 3463 - DNA, 45 bp, Artificial sequence
  Synthetic oligonucleotide probe
ctctccagagtgatcaagtgtgacccggtaagtgagggtgatgtc

SEQ ID NO: 3464 - DNA, 45 bp, Artificial sequence
  Synthetic oligonucleotide probe
gccttgccggggcttacagggggagacacctagtgccacggaaat

SEQ ID NO: 3465 - DNA, 45 bp, Artificial sequence
  Synthetic oligonucleotide probe
tactgactggctgggaggtcctcacagccttctcacgtcccctgg

SEQ ID NO: 3466 - DNA, 45 bp, Artificial sequence
  Synthetic oligonucleotide probe
gtagagtttctgggcgaagcgtccgggacggaggccccaggcggc

SEQ ID NO: 3467 - DNA, 45 bp, Artificial sequence
  Synthetic oligonucleotide probe
gagacaccggacaacgggcggatagagacagccttgttgtttacg

SEQ ID NO: 3468 - DNA, 45 bp, Artificial sequence
  Synthetic oligonucleotide probe
gtcagccgccggccccgcggtgtgtgagggagtgaccgcctgacc

SEQ ID NO: 3469 - DNA, 45 bp, Artificial sequence
  Synthetic oligonucleotide probe
gagcctcccggggactccgcacgggtctcagcagatgctatctag

SEQ ID NO: 3470 - DNA, 45 bp, Artificial sequence
  Synthetic oligonucleotide probe
ctcagcagatgctatctagggtccacctgcctgtcccctgcctag

SEQ ID NO: 3471 - DNA, 45 bp, Artificial sequence
  Synthetic oligonucleotide probe
acactgggagtagcggctgcccagcccatgtgtgtctcggaagag

SEQ ID NO: 3472 - DNA, 45 bp, Artificial sequence
  Synthetic oligonucleotide probe
ttctcggccatggcctcccttgcaccctgccccgtgttatccttt

SEQ ID NO: 3473 - DNA, 45 bp, Artificial sequence
  Synthetic oligonucleotide probe
ctccagaagcccagcaaagagaaagcccctccatcaaaatgaaac

SEQ ID NO: 3474 - DNA, 49 bp, Artificial sequence
  Synthetic oligonucleotide probe
ctccatcaaaatgaaactcgcgtctgcacttttcatttcgaactccacg

SEQ ID NO: 3475 - DNA, 45 bp, Artificial sequence
  Synthetic oligonucleotide probe
gagtgaaaaccgcttccccgccaggggtgactgccctgggatgtt

SEQ ID NO: 3476 - DNA, 45 bp, Artificial sequence
  Synthetic oligonucleotide probe
ggcagttgtgggaagttgggcgctggcccttatttgagtagagac

SEQ ID NO: 3477 - DNA, 52 bp, Artificial sequence
  Synthetic oligonucleotide probe
attttctagggcgtgttctagaattttctttggtgggtggaatgtccatctg

SEQ ID NO: 3478 - DNA, 45 bp, Artificial sequence
  Synthetic oligonucleotide probe
atctgtgcaaatcgggtgcgcagtgccacacaccagtgacttttc

SEQ ID NO: 3479 - DNA, 45 bp, Artificial sequence
  Synthetic oligonucleotide probe
gagtgggtcatgggcgagggacgggccgcaggtgaagaatccctg

SEQ ID NO: 3480 - DNA, 46 bp, Artificial sequence
  Synthetic oligonucleotide probe
ttcatttgccatgatgagaatttatctgaggggcgggagaggaaag

SEQ ID NO: 3481 - DNA, 45 bp, Artificial sequence
  Synthetic oligonucleotide probe
gtcatcgcctgtcgtgctatgcctttgtccagccccttctggttg

SEQ ID NO: 3482 - DNA, 45 bp, Artificial sequence
  Synthetic oligonucleotide probe
cttctggttgggagttaagtggcacctgtgcggcacgtggtgggg

SEQ ID NO: 3483 - DNA, 45 bp, Artificial sequence
  Synthetic oligonucleotide probe
ttgtggaaggtctgtttcctgggctgcctagagacttggcttgaa

SEQ ID NO: 3484 - DNA, 45 bp, Artificial sequence
  Synthetic oligonucleotide probe
gacacacacagccccaacacatggagccggttctccatccagaag

SEQ ID NO: 3485 - DNA, 45 bp, Artificial sequence
  Synthetic oligonucleotide probe
ggcagtaagcagccacttcaggctgcgtgggacttgcccgtggtg

SEQ ID NO: 3486 - DNA, 45 bp, Artificial sequence
  Synthetic oligonucleotide probe
cacttcaggctgcgtgggacttgcccgtggtggagcctaggagag

SEQ ID NO: 3487 - DNA, 45 bp, Artificial sequence
  Synthetic oligonucleotide probe
agcctaggagaggcccctggctgggcgtggcgttccagatttcac

SEQ ID NO: 3488 - DNA, 45 bp, Artificial sequence
  Synthetic oligonucleotide probe
gatttcacggctgctctttcccactgacagtgtggtgtggacgct

SEQ ID NO: 3489 - DNA, 45 bp, Artificial sequence
  Synthetic oligonucleotide probe
ctgccaagggagtctggagccccagagggtggaggtgcaggactt

SEQ ID NO: 3490 - DNA, 45 bp, Artificial sequence
  Synthetic oligonucleotide probe
gagggtggaggtgcaggacttccaggagcgtccgtcgcactccac

SEQ ID NO: 3491 - DNA, 45 bp, Artificial sequence
  Synthetic oligonucleotide probe
acctcagtggccgcagtgggtggatgcatgctgtgccaggctgat

SEQ ID NO: 3492 - DNA, 45 bp, Artificial sequence
  Synthetic oligonucleotide probe
ctgatggctggccccggggcacaggcctgagcgggagaggatgga

SEQ ID NO: 3493 - DNA, 45 bp, Artificial sequence
  Synthetic oligonucleotide probe
agggatcaatggtccaggtccccctggccacccagcattcatcct

SEQ ID NO: 3494 - DNA, 45 bp, Artificial sequence
  Synthetic oligonucleotide probe
acccagcattcatcctcagtcatgcacggcccaaggcttcgacag

SEQ ID NO: 3495 - DNA, 45 bp, Artificial sequence
  Synthetic oligonucleotide probe
atcctcagtcatgcacggcccaaggcttcgacagccattgatcat

SEQ ID NO: 3496 - DNA, 45 bp, Artificial sequence
  Synthetic oligonucleotide probe
ccaggttcacctcaagggctgccacatggagaggttaagtctgaa

SEQ ID NO: 3497 - DNA, 48 bp, Artificial sequence
  Synthetic oligonucleotide probe
cacatggagaggttaagtctgaaaaggctgaaaaggcagggttcaaag

SEQ ID NO: 3498 - DNA, 45 bp, Artificial sequence
  Synthetic oligonucleotide probe
cggtgaaggcgctgttggacatggggacgggcagggggtgtgcag

SEQ ID NO: 3499 - DNA, 49 bp, Artificial sequence
  Synthetic oligonucleotide probe
agggacagtttttggcttagtcttgctcttataaaggcttccgggtcat

SEQ ID NO: 3500 - DNA, 45 bp, Artificial sequence
  Synthetic oligonucleotide probe
tgccaggagcagatcgaagccctgctggagtcaagcctgcgccag

SEQ ID NO: 3501 - DNA, 45 bp, Artificial sequence
  Synthetic oligonucleotide probe
acgtggacatctgagggcgccaggcaggcgggcgccaccgccacc

SEQ ID NO: 3502 - DNA, 45 bp, Artificial sequence
  Synthetic oligonucleotide probe
gccacccgcagcgagggcggagccggccccaggtgctcccctgac

SEQ ID NO: 3503 - DNA, 60 bp, Artificial sequence
  Synthetic oligonucleotide probe
aggagggttgtgctacagatgatagaggattttataccccaataatcaactcgtttttat

SEQ ID NO: 3504 - DNA, 49 bp, Artificial sequence
  Synthetic oligonucleotide probe
taagaataggcattaacacaaaggaggcgtctcgggagaggattaggtt

SEQ ID NO: 3505 - DNA, 60 bp, Artificial sequence
  Synthetic oligonucleotide probe
tcactttataagtcattgtatgttattatattccgtaggtagatgtgtaacctcttcacc

SEQ ID NO: 3506 - DNA, 45 bp, Artificial sequence
  Synthetic oligonucleotide probe
aagtcacctcttggttacagtagcgtagcgtgcccgtgtgcatgt

SEQ ID NO: 3507 - DNA, 45 bp, Artificial sequence
  Synthetic oligonucleotide probe
gtgtgcatgtcctttgcgcctgtgaccaccaccccaacaaaccat

SEQ ID NO: 3508 - DNA, 45 bp, Artificial sequence
  Synthetic oligonucleotide probe
cccaacaaaccatccagtgacaaaccatccagtggaggtttgtcg

SEQ ID NO: 3509 - DNA, 45 bp, Artificial sequence
  Synthetic oligonucleotide probe
gtggaggtttgtcgggcaccagccagcgtagcagggtcgggaaag

SEQ ID NO: 3510 - DNA, 53 bp, Artificial sequence
  Synthetic oligonucleotide probe
ttcctatttttgtagtgacctgtttatgagatgctggttttctacccaacggc

SEQ ID NO: 3511 - DNA, 53 bp, Artificial sequence
  Synthetic oligonucleotide probe
aagcactttcagtccaataggtgtaggaaatagcgctgtttttgttgtgtgtg

SEQ ID NO: 3512 - DNA, 47 bp, Artificial sequence
  Synthetic oligonucleotide probe
cgtgccagtcaagaagaaaaaggtttgcattctcacattgccaggat

SEQ ID NO: 3513 - DNA, 54 bp, Artificial sequence
  Synthetic oligonucleotide probe
gtgtttgaaagtagggacctcagaggtttacctagagaacaggtggtttttaag

SEQ ID NO: 3514 - DNA, 58 bp, Artificial sequence
  Synthetic oligonucleotide probe
ctcagaggtttacctagagaacaggtggtttttaagggttatcttagatgtttcacac

SEQ ID NO: 3515 - DNA, 46 bp, Artificial sequence
  Synthetic oligonucleotide probe
attgattcagcctgtttggcgtttcccagagtcatctgattggaca

SEQ ID NO: 3516 - DNA, 54 bp, Artificial sequence
  Synthetic oligonucleotide probe
taagttcggttccgatgaattcttatcccctgccccttcctttaaaaaacttag

SEQ ID NO: 3517 - DNA, 60 bp, Artificial sequence
  Synthetic oligonucleotide probe
acggtttggaaatattcacatcgcttctgtgtatctctttcacattgtttgctgctattg

SEQ ID NO: 3518 - DNA, 58 bp, Artificial sequence
  Synthetic oligonucleotide probe
attactgctctattccaaaaaggttgctgtttcacaatacctcatgcttcacttagcc

SEQ ID NO: 3519 - DNA, 45 bp, Artificial sequence
  Synthetic oligonucleotide probe
ttcacttagccatggtggacccagcgggcaggttctgcctgcttt

SEQ ID NO: 3520 - DNA, 48 bp, Aedes albopictus densovirus 2
ctggccctttaaaatgtgggtcccacatgagggtattgttgtctattc

SEQ ID NO: 3521 - DNA, 55 bp, Aedes albopictus densovirus 2
ggtattgttgtctattcactctatcaattcccgctcaattattgggcctctgttc

SEQ ID NO: 3522 - DNA, 53 bp, Aedes albopictus densovirus 2
gctcaattattgggcctctgttcactaaggccttataaggcccttaatgaatt

SEQ ID NO: 3523 - DNA, 45 bp, Aedes albopictus densovirus 2
aaattgtcggatttgtgggtcctcttttgcctgccccattaacga

SEQ ID NO: 3524 - DNA, 60 bp, Aedes albopictus densovirus 2
attttcgtagaaaatacatagaaacttccccgggtttgatttcctatctcaatgccttac

SEQ ID NO: 3525 - DNA, 56 bp, Aedes albopictus densovirus 2
cccgggtttgatttcctatctcaatgccttacaagcggaaattaacgagttatttt

SEQ ID NO: 3526 - DNA, 46 bp, Aedes albopictus densovirus 2
aatcaaagaggtttcgcggagcgaaatccggcatggcagttgtgaa

SEQ ID NO: 3527 - DNA, 47 bp, Aedes albopictus densovirus 2
cagttgtgaagacaagtgccagccgtcgtctatacaaaaagggaaag

SEQ ID NO: 3528 - DNA, 60 bp, Aedes albopictus densovirus 2
agtgacatcgagattttgaagtcgatgtatattcgccttactgttgctctgtctgaaaat

SEQ ID NO: 3529 - DNA, 57 bp, Aedes albopictus densovirus 2
tatattcgccttactgttgctctgtctgaaaatgctgcttctcaagtgaagacctat

SEQ ID NO: 3530 - DNA, 54 bp, Aedes albopictus densovirus 2
cttctcaagtgaagacctatgtggttaaatgggctctaattgtggatcaggttc

SEQ ID NO: 3531 - DNA, 58 bp, Aedes albopictus densovirus 2
cctctccttatccttatgtgcagtgtgcctatattgctgatgataatcacagtcgttt

SEQ ID NO: 3532 - DNA, 54 bp, Aedes albopictus densovirus 2
gatgataatcacagtcgtttccaagtgctgaggagtgggtttcttagtcttagt

SEQ ID NO: 3533 - DNA, 57 bp, Aedes albopictus densovirus 2
agtgggtttcttagtcttagtggtaatggtcttgcagttggatcttctactagaact

SEQ ID NO: 3534 - DNA, 50 bp, Aedes albopictus densovirus 2
ctactggcgatatcgccagtattaagcgcggtgccgtttatcttgtaatc

SEQ ID NO: 3535 - DNA, 60 bp, Aedes albopictus densovirus 2
cgatctaattacattatttatactaataacacctaaattattcaaatgtttcattacatg

SEQ ID NO: 3536 - DNA, 45 bp, Aedes albopictus densovirus 2
aagttcagccaacaaatctggagacccaacactttccgcaggttg

SEQ ID NO: 3537 - DNA, 49 bp, Aedes albopictus densovirus 2
attgttgttgtgttctggaggcggaagtaaattgggttcttgatgtcgt

SEQ ID NO: 3538 - DNA, 45 bp, Aedes albopictus densovirus 2
gtgaatggcctttcgtctctttttcttcggtgcccaagtcagttt

SEQ ID NO: 3539 - DNA, 46 bp, Aedes albopictus densovirus 2
ctttttcttcggtgcccaagtcagtttggggggtcgttttttgata

SEQ ID NO: 3540 - DNA, 54 bp, Aedes albopictus densovirus 2
agtattctgggtataagcacctttcgcagaaacccttccttatctccctatttc

SEQ ID NO: 3541 - DNA, 60 bp, Aedes albopictus densovirus 2
tacagcattatagagtgtccaatcttttaaagcctcattctcttccttatcgaggaagtc

SEQ ID NO: 3542 - DNA, 45 bp, Aedes albopictus densovirus 2
tcttggaaagaggtgtccccaccagggttgcaaaggactattgat

SEQ ID NO: 3543 - DNA, 58 bp, Aedes albopictus densovirus 2
gttgcaaaggactattgatgggatgccacctttaatttgaactggctttccatattta

SEQ ID NO: 3544 - DNA, 56 bp, Aedes albopictus densovirus 2
atgccacctttaatttgaactggctttccatatttacagtttgactgccagtctct

SEQ ID NO: 3545 - DNA, 60 bp, Aedes albopictus densovirus 2
gacgttatacaaggcactatttgaatacactctgctgttaaaatctaagtggccggataa

SEQ ID NO: 3546 - DNA, 60 bp, Aedes albopictus densovirus 2
cacattgtcttgccggtcctagactcaccctcaattataatacttttatatctcataggc

SEQ ID NO: 3547 - DNA, 60 bp, Aedes albopictus densovirus 2
cctcaattataatacttttatatctcataggccgcgcagcggcactaactccaaaataat

SEQ ID NO: 3548 - DNA, 60 bp, Aedes albopictus densovirus 2
actaactccaaaataatcatccgcccattcttgcatatcttcaggaacgttagtaaatga

SEQ ID NO: 3549 - DNA, 60 bp, Aedes albopictus densovirus 2
attcttgcatatcttcaggaacgttagtaaatgaagataattgaaacggagggacaaacg

SEQ ID NO: 3550 - DNA, 49 bp, Aedes albopictus densovirus 2
ggagggacaaacggagttggtgccggagtaaaaatcctatctaagttag

SEQ ID NO: 3551 - DNA, 51 bp, Aedes albopictus densovirus 2
ctctagcagatctagcgtcaatctggaattctccccattcgatagtgtctc

SEQ ID NO: 3552 - DNA, 50 bp, Aedes albopictus densovirus 2
aaatgtgttgacctggttggggataccaggtcgaagaatcgttgattttt

SEQ ID NO: 3553 - DNA, 60 bp, Aedes albopictus densovirus 2
aagaatcgttgatttttgcagttgaatttcccttcgaattgtataagcacatggagatga

SEQ ID NO: 3554 - DNA, 58 bp, Aedes albopictus densovirus 2
attgggatatgtgaggaaatagttcttggctgctatttgaaaacgtttgggattggat

SEQ ID NO: 3555 - DNA, 60 bp, Aedes albopictus densovirus 2
aaatatgtgttggttaccaattggtttgctttttaattctctaaatgaatcggtaactgg

SEQ ID NO: 3556 - DNA, 60 bp, Aedes albopictus densovirus 2
accacatgatccacagagtatataagaggtataaatgaagggagagtcagtagtatggaa

SEQ ID NO: 3557 - DNA, 52 bp, Aedes albopictus densovirus 2
gaacattcgccgtgtgaacacggcaatatagagtgtgagtgcattttttgtt

SEQ ID NO: 3558 - DNA, 47 bp, Maize streak virus
atgacgcacagtgtaaatccaggaggagagaattggatttgggagag

SEQ ID NO: 3559 - DNA, 59 bp, Maize streak virus
gagcgagatatcagagaagatttcacagatcaaaccgttgataacatctacccacaatt

SEQ ID NO: 3560 - DNA, 60 bp, Maize streak virus
tctcaagccagattataaggaagaagattttcaatcacatattagacgtgttcgaagaca

SEQ ID NO: 3561 - DNA, 60 bp, Maize streak virus
atcacatattagacgtgttcgaagacagttattccccgaaaaaactatggataataacgg

SEQ ID NO: 3562 - DNA, 54 bp, Maize streak virus
aaaaactatggataataacgggtcacaggcaagcacaacccaaatgttacgaga

SEQ ID NO: 3563 - DNA, 53 bp, Maize streak virus
caaatgttacgagacgacatcgaaagatgcggtattgaaagcattgctgacag

SEQ ID NO: 3564 - DNA, 49 bp, Maize streak virus
tattgaaagcattgctgacagcgcaagcgaagataacggagatggagtt

SEQ ID NO: 3565 - DNA, 52 bp, Maize streak virus
caccgtggatatacaaggcaactgtattgttaacgcacatggcaatgaacag

SEQ ID NO: 3566 - DNA, 51 bp, Maize streak virus
tattgttaacgcacatggcaatgaacaggcaacaggcagtaagaccagaaa

SEQ ID NO: 3567 - DNA, 57 bp, Maize streak virus
atactacacattcgtcctccacaaaaataactgcaaagaggactggagatatatcgc

SEQ ID NO: 3568 - DNA, 50 bp, Maize streak virus
acaggaggaaacagcacaagagtcagaaccagaatcaccaagtttcttag

SEQ ID NO: 3569 - DNA, 59 bp, Maize streak virus
ttagtgcaacaagcgcaggaaatgcagaagcgactatcactttttccaaagttaaattt

SEQ ID NO: 3570 - DNA, 60 bp, Maize streak virus
gcgactatcactttttccaaagttaaatttctcaggaactacattctctattgcatccgt

SEQ ID NO: 3571 - DNA, 60 bp, Maize streak virus
ccgttacggtatcgaaacagtcaatatctatggaaataaaatccaacaacaattaactga

SEQ ID NO: 3572 - DNA, 60 bp, Maize streak virus
caacaatgggaaaatatcatcgaaccagaattcaaaatacaactgatgaaagagtttggt

SEQ ID NO: 3573 - DNA, 60 bp, Maize streak virus
tgaaataatggtggagatattaaatgaagaatatatcaaaaacttcacacccggagaaga

SEQ ID NO: 3574 - DNA, 60 bp, Maize streak virus
cgcaggtaaatcgctaatattagacaacttattagcaatggttaaaccggaagaaatacc

SEQ ID NO: 3575 - DNA, 53 bp, Maize streak virus
ggaagaaataccaagagaaagagacaacagcggattccacttggatcaactac

SEQ ID NO: 3576 - DNA, 60 bp, Maize streak virus
actatacatattcaaaaagagtatacaacacagagaagacaaatatactataaatgcaca

SEQ ID NO: 3577 - DNA, 60 bp, Maize streak virus
caacacagagaagacaaatatactataaatgcacaaattcaaaacaaactcatcagtcgg

SEQ ID NO: 3578 - DNA, 60 bp, Maize streak virus
cgcacatacagtaaatgaaaaagcaatcagattaagtgaggaagcaaaacaagaagcaga

SEQ ID NO: 3579 - DNA, 48 bp, Maize streak virus
gatcaggacaaggagtcggaaaaggaaacagcaacgcagtaaaagaag

SEQ ID NO: 3580 - DNA, 60 bp, Maize streak virus
gacattggaaataatcaaagtatcaatatcatgaaagcattaaacgctgtagcactagga

SEQ ID NO: 3581 - DNA, 60 bp, Maize streak virus
gtaacctggatcaaaggagaaatcacattcgaagtatattcagtaacaagacagagactg

SEQ ID NO: 3582 - DNA, 59 bp, Maize streak virus
tatattcagtaacaagacagagactgctaacgggaacaacaaatcaaacaacttgggac

SEQ ID NO: 3583 - DNA, 58 bp, Maize streak virus
taacgggaacaacaaatcaaacaacttgggacttcgaaacaagtcaaaacatgttcat

SEQ ID NO: 3584 - DNA, 52 bp, Maize streak virus
aagtcaaaacatgttcatcgcagacgcagacagagaaccggaaaatttcaac

SEQ ID NO: 3585 - DNA, 50 bp, Maize streak virus
ggaaaatttcaacctagaaacagttgcagcaaccggaccattagcacaac

SEQ ID NO: 3586 - DNA, 60 bp, Maize streak virus
aacaacacaaacattactattcaattctcacaatgacagatacacaaaatacgaactacc

SEQ ID NO: 3587 - DNA, 60 bp, Maize streak virus
acgaactaccacaaaggaaccaatatacaagggaaatcaacttccagcaattaacaaata

SEQ ID NO: 3588 - DNA, 60 bp, Maize streak virus
tacaaaatcggagaacttgagacaaacggaattcacatatgaaactacaacatatgccac

SEQ ID NO: 3589 - DNA, 49 bp, Maize streak virus
gtcaggagcaacaacgaggcaaaccctattcaggaacagaacatcatat

SEQ ID NO: 3590 - DNA, 56 bp, Maize streak virus
cctattcaggaacagaacatcatatccaagaatgcacattgcacaaccacaagttc

SEQ ID NO: 3591 - DNA, 54 bp, Maize streak virus
aagaatgcacattgcacaaccacaagttccagacgaaacaggattcatgaaatt

SEQ ID NO: 3592 - DNA, 60 bp, Maize streak virus
acatttaaacttccacatgtatccagattacgccacaaataacaaccttgaatatatgca

SEQ ID NO: 3593 - DNA, 60 bp, Maize streak virus
agacaaacaatcttactaccacaagtagcagaaactaatggaattgtagcatgtatgcct

SEQ ID NO: 3594 - DNA, 60 bp, Maize streak virus
gataatgtccaccacagaaatatactgttaaactccacttgttaaactccacctcagaac

SEQ ID NO: 3595 - DNA, 45 bp, Maize streak virus
agaaagccaacattagttcgggatccccgtgtgtcccctgttaat

SEQ ID NO: 3596 - DNA, 45 bp, Maize streak virus
taagagaaagccaacattagtccgggatccccgtgtgagccgata

SEQ ID NO: 3597 - DNA, 58 bp, Maize streak virus
attgatttgcttttacctgctttacctttgggtgctgagagaccttatcttagttctg

SEQ ID NO: 3598 - DNA, 45 bp, Maize streak virus
aatcccgggccatttgttccaggcacgggataagcaatcagccat

SEQ ID NO: 3599 - DNA, 45 bp, Tomato pseudo-curly  top virus
ataagcaatcagccatgtccacgtccaagaggaagcggggagatg

SEQ ID NO: 3600 - DNA, 47 bp, Tomato pseudo-curly  top virus
agatgatgcgaattggagtaagcgggtgcctaagaagaagccttctt

SEQ ID NO: 3601 - DNA, 45 bp, Tomato pseudo-curly  top virus
aaatccagacactccagcatgctgggaccaccatgataactgtcc

SEQ ID NO: 3602 - DNA, 48 bp, Tomato pseudo-curly  top virus
atgataactgtcccatccggaggagtatgtgacctcatcaacacctat

SEQ ID NO: 3603 - DNA, 45 bp, Tomato pseudo-curly  top virus
gagtatgtgacctcatcaacacctatgcccgaggatctgacgagg

SEQ ID NO: 3604 - DNA, 45 bp, Tomato pseudo-curly  top virus
caaactatatttgcctaccctgacacgctaaaagcgtggccggcc

SEQ ID NO: 3605 - DNA, 45 bp, Tomato pseudo-curly  top virus
cgacggtcggattggttcggatatccctccctcgaatacaagttg

SEQ ID NO: 3606 - DNA, 45 bp, Tomato pseudo-curly  top virus
attggttcggatatccctccctcgaatacaagttggaagccttgc

SEQ ID NO: 3607 - DNA, 46 bp, Tomato pseudo-curly  top virus
aagttggaagccttgcaagcgcaacatctacttccacaagttcacg

SEQ ID NO: 3608 - DNA, 60 bp, Tomato pseudo-curly  top virus
gagtgttggcaaccagtaatgaataaaaacgcccgttttattatatctgatgaatgctga

SEQ ID NO: 3609 - DNA, 45 bp, Tomato pseudo-curly  top virus
acgaaaaaacacacgcaatcaatacaggggggtagtcggcgggcg

SEQ ID NO: 3610 - DNA, 49 bp, Tomato pseudo-curly  top virus
ctaagggtggtgctcggcgggcaaaacatcgaaaaatcaagatctatat

SEQ ID NO: 3611 - DNA, 60 bp, Tomato pseudo-curly  top virus
caaaacatcgaaaaatcaagatctatatgaattacacttcctccgtaggaggaagcacag

SEQ ID NO: 3612 - DNA, 45 bp, Tomato pseudo-curly  top virus
aattacacttcctccgtaggaggaagcacagggggagaataccac

SEQ ID NO: 3613 - DNA, 54 bp, Tomato pseudo-curly  top virus
cttcatccaatcttcatccgagttggcgaggattattgtaggcttagacttctt

SEQ ID NO: 3614 - DNA, 60 bp, Tomato pseudo-curly  top virus
taggcttagacttcttctgcacctttttcttcttaccatacttggggtttacaatgaaat

SEQ ID NO: 3615 - DNA, 53 bp, Tomato pseudo-curly  top virus
atacttggggtttacaatgaaatccctctgacagccaactaactgtttccaac

SEQ ID NO: 3616 - DNA, 60 bp, Tomato pseudo-curly  top virus
gccaactaactgtttccaacaaggacagaatttaaacggaatatcatctacgatgttgta

SEQ ID NO: 3617 - DNA, 51 bp, Tomato pseudo-curly  top virus
ccgacgatgtagaggctctgctttcttgatctttcatctgatgactggata

SEQ ID NO: 3618 - DNA, 55 bp, Tomato pseudo-curly  top virus
ctctgctttcttgatctttcatctgatgactggatacagaatccatccattggag

SEQ ID NO: 3619 - DNA, 51 bp, Tomato pseudo-curly  top virus
atacagaatccatccattggaggtcagagattgcatcctcgagggtataac

SEQ ID NO: 3620 - DNA, 58 bp, Tomato pseudo-curly  top virus
aagatgttaggctggagccaatcattgattgactcattacaaagtaaatcaggtgagg

SEQ ID NO: 3621 - DNA, 57 bp, Tomato pseudo-curly  top virus
gagaatgtaatccctcactctgttaactgacttggcactctgaatatttgggtgaaa

SEQ ID NO: 3622 - DNA, 60 bp, Tomato pseudo-curly  top virus
aatatttgggtgaaacccatttatatcaaagaaccttgagtcagatatccttaccggctt

SEQ ID NO: 3623 - DNA, 60 bp, Tomato pseudo-curly  top virus
atatccttaccggcttctctgtctgaagcaatgcatgtaaatgcaaacttccatctttat

SEQ ID NO: 3624 - DNA, 51 bp, Tomato pseudo-curly  top virus
gattttctggacactttggataggttaggaacgtgttagcgttcctgtgtg

SEQ ID NO: 3625 - DNA, 45 bp, Tomato pseudo-curly  top virus
cgccttcgaaatccgccgctcccttgtcttatagtggttgtaaat

SEQ ID NO: 3626 - DNA, 45 bp, Tomato pseudo-curly  top virus
ttcttttcctgcgagggcccggtagggaccgagcgctttgattta

SEQ ID NO: 3627 - DNA, 55 bp, Tomato pseudo-curly  top virus
cctggttctgctttgtatgatttatctaaagcagcccaatctaaagaaaccggtc

SEQ ID NO: 3628 - DNA, 51 bp, Tomato pseudo-curly  top virus
aatctaaagaaaccggtcccgggcactataaattgcctaacaagtgcgatt

We claim:

1. A probe set comprising:
   (a) probes having at least 90% identity with the nucleic acid sequences of SEQ ID NOs: 1-1300, 1391-1570, and 1691-1769;
   (b) probes having at least 95% identity with the nucleic acid sequences of SEQ ID NOs: 1-1300, 1391-1570, and 1691-1769;
   (c) probes comprising the nucleic acid sequence of SEQ ID NOs: 1-1300, 1391-1570, and 1691-1769; or
   (d) probes comprising the nucleic acid sequence of SEQ ID NOs: 1-1769,
   wherein each of the probes is covalently linked to a solid support and each of the probes is 60 nucleotides in length.

2. The probe set of claim 1, wherein the probe set comprises probes for each of Chikungunya virus, Dengue virus type 1, Dengue virus type 2, Dengue virus type 3, Dengue virus type 4, Hepatitis A virus, Hepatitis C virus type 1, Hepatitis C virus type 2, Hepatitis C virus type 3, Hepatitis E virus, Human immunodeficiency virus type 1, Human immunodeficiency virus type 2, Human T-lymphotropic virus type I, Human T-lymphotropic virus type II, West Nile virus, and Zika virus.

3. The probe set of claim 1, further comprising at least one negative control probe and/or further comprising at least one positive control probe.

4. The probe set of claim 3, wherein the at least one negative control probe comprises a set of probes with at least 90% identity with each of the nucleic acid sequences of SEQ ID NOs: 1571-1690 and wherein each of the probes is 60 nucleotides in length.

5. The probe set of claim 1, further comprising:
   (a) probes having at least 90% identity with the nucleic acid sequences of SEQ ID NOs: 1770-2647;
   (b) probes having at least 95% identity with the nucleic acid sequences of SEQ ID NOS: 1770-2647; or
   (c) probes comprising the nucleic acid sequence of SEQ ID NOs: 1770-2647;
   wherein each of the probes is covalently linked to a solid support and each of the probes is 40-60 nucleotides in length.

6. The probe set of claim 5, wherein the probe set comprises probes for each of cytomegalovirus, Epstein Barr virus subtype B95-8, Epstein Barr virus subtype AG876, human herpes virus 8, Hepatitis B virus subtype adw, Hepatitis B virus subtype ayw, Hepatitis B virus subtype adr, Hepatitis B virus subtype ayr, human parvovirus B19, human papillomavirus type 6, human papillomavirus type 11, human papillomavirus type 16, and human papillomavirus type 18.

7. The probe set of claim 5, further comprising at least one negative control probe and/or further comprising at least one positive control probe.

8. The probe set of claim 7, wherein the at least one negative control probe comprises a set of probes with at least 90% identity with the nucleic acid sequences of each of SEQ ID NOs: 3520-3628 and each of the probes is 45-60 nucleotides in length.

9. The probe set of claim 1, further comprising:
   (a) probes having at least 90% identity with the nucleic acid sequences of SEQ ID NOs: 2648-3207;
   (b) probes having at least 95% identity with the nucleic acid sequences of SEQ ID NOs: 2648-3207; or
   (c) probes comprising the nucleic acid sequence of SEQ ID NOs: 2648-3207;
   wherein each of the probes is covalently linked to a solid support and each of the probes is 45-60 nucleotides in length.

10. The probe set of claim 9, wherein the probe set comprises at least one probe for each of *Treponema pallidum, Ehrlichia chaffeensis, Ehrlichia ewingii, Ehrlichia muris, Borrelia burgdorferi, Coxiella burnetii, Trypanosoma brucei, Trypanosoma cruzi Leishmania major, Babesia microti, Plasmodium falciparum*, and *Plasmodium vivax*.

11. The probe set of claim 9, further comprising at least one negative control probe and/or further comprising at least one positive control probe.

12. The probe set of claim 11, wherein the at least one positive control probe comprises a set of probes with at least 90% identity with the nucleic acid sequences of each of SEQ ID NOs: 3208-3519 and each of the probes is 45-60 nucleotides in length.

13. A microarray comprising the probe set of claim 1.

14. The microarray of claim 13, wherein the probe set comprises probes comprising the nucleic acid sequence of each of SEQ ID NOs: 1-1769.

15. A method of detecting one or more pathogen nucleic acids in a sample, comprising:
   contacting the sample with the probe set of claim 1 under conditions sufficient to allow hybridization of pathogen nucleic acids present in the sample to the probes of the probe set; and
   measuring hybridization of the sample to one or more of the probes, thereby detecting one or more pathogen nucleic acids in the sample.

16. The method of claim 15, wherein the sample comprises a blood, serum, or plasma sample or nucleic acids isolated from a blood, serum, or plasma sample.

17. The method of claim 16, further comprising isolating nucleic acids from the sample prior to contacting the sample with the probe set.

18. The method of claim 17, further comprising labeling the isolated nucleic acids from the sample.

19. The method of claim 18, wherein the isolated nucleic acids are isolated DNA, isolated RNA, isolated cDNA, or a combination of two or more thereof.

20. The method of claim 19, wherein labeling the isolated nucleic acids comprises labeling the nucleic acids with one or more fluorescent labels.

21. The method of claim 17, wherein the isolated nucleic acids are cDNA.

22. The method of claim 17, wherein isolating the nucleic acids does not comprise amplifying total RNA from the sample prior to preparing cDNA.

23. The method of claim 15, wherein measuring hybridization comprises detecting ≥50% of the probes for the virus have a log ratio of >1.5 and/or the log ratio between the signal intensity mean for the probe set and the mean of a control group probe set is ≥1.5.

24. The method of claim 15, wherein the pathogen nucleic acids comprise nucleic acids from one or more of Chikungunya virus, Dengue virus types 1, 2, 3, or 4, Hepatitis A virus, Hepatitis C virus types 1, 2, or 3, Hepatitis E virus, Human immunodeficiency virus types 1 or 2, Human T-lymphotropic virus types I or II, West Nile virus, and Zika virus.

* * * * *